(12) United States Patent
Córte-Real et al.

(10) Patent No.: US 11,672,839 B2
(45) Date of Patent: Jun. 13, 2023

(54) BACTERIOPHAGE COMPOSITIONS COMPRISING RESPIRATORY ANTIBACTERIAL PHAGES AND METHODS OF USE THEREOF

(71) Applicants: TECHNOPHAGE, INVESTIGACAO E DESENVOLVIMENTO EM BIOTECNOLOGIA, SA, Lisbon (PT); TECNIFAR—INDUSTRIA TECNICA FARMACEUTICA, SA, Lisbon (PT)

(72) Inventors: Sofia Valker Córte-Real, Lisbon (PT); Miguel Ângelo Costa Garcia, Lisbon (PT); Clara Isabel Rodrigues Leandro, Lisbon (PT); Ana Raquel Martins Barbosa, Sobreda (PT)

(73) Assignees: TECHNECHNOPHAGE, INVESTIGACAO E DESENVOLVIMENTO EM BIOTECNOLOGIA, SA, Lisbon (PT); TECNIFAR—INDUSTRIA TECNICA FARMACEUTICA, SA, Lisbon (PT)

( * ) Notice: Subject to any disclaimer, the term of this patent is extended or adjusted under 35 U.S.C. 154(b) by 171 days.

(21) Appl. No.: 16/466,943

(22) PCT Filed: Dec. 4, 2017

(86) PCT No.: PCT/PT2017/050028
§ 371 (c)(1),
(2) Date: Jun. 5, 2019

(87) PCT Pub. No.: WO2018/106135
PCT Pub. Date: Jun. 14, 2018

(65) Prior Publication Data
US 2019/0290709 A1    Sep. 26, 2019

Related U.S. Application Data

(60) Provisional application No. 62/430,113, filed on Dec. 5, 2016.

(51) Int. Cl.
| | | |
|---|---|---|
| *A61K 35/76* | (2015.01) | |
| *A61K 9/00* | (2006.01) | |
| *A61P 31/04* | (2006.01) | |
| *C12N 7/00* | (2006.01) | |
| *C12Q 1/04* | (2006.01) | |
| *A01N 63/40* | (2020.01) | |

(52) U.S. Cl.
CPC .............. *A61K 35/76* (2013.01); *A01N 63/40* (2020.01); *A61K 9/0073* (2013.01); *A61P 31/04* (2018.01); *C12N 7/00* (2013.01); *C12Q 1/04* (2013.01); *C12N 2795/00011* (2013.01); *C12N 2795/00021* (2013.01); *C12N 2795/00031* (2013.01); *C12N 2795/00032* (2013.01); *C12N 2795/00071* (2013.01)

(58) Field of Classification Search
None
See application file for complete search history.

(56) References Cited

U.S. PATENT DOCUMENTS

2015/0150919 A1*  6/2015  Alves Mendes ........ A61P 17/02
                                                        424/93.3

FOREIGN PATENT DOCUMENTS

| AU | 2015255313 | 12/2015 | |
|---|---|---|---|
| WO | WO 2010/041970 | 4/2010 | |
| WO | WO 2010/090542 | 8/2010 | |
| WO | WO 2011/065854 | 6/2011 | |
| WO | WO 2012/036580 | 3/2012 | |
| WO | WO-2012036580 A2 * | 3/2012 | .............. A61P 17/00 |
| WO | WO 2013/141730 | 9/2013 | |

OTHER PUBLICATIONS

Lynch, K.H. et al. 2012. Comparative analysis of two phenotypically-similar but genomically-distinct Burkholderia cenocepacia specific bacteriophages. BMC Genomics 13(223): 1-9. specif. pp. 1, 16.*
Esson, C. et al. 2013. The susceptibility of Pseudomonas aeruginosa strains from cystic fibrosis patients to bacteriophages. PLOS One 8(4): 1-12. specif. pp. 1, 3, 5, 9.*
Henry, M. et al. 2013. Predicting in vivo efficacy of therapeutic bacteriophages used to treat pulmonary infections. Antimicrobial Agents and Chemotherapy 57(12): 5961-5968. specif. pp. 5961, 5962.*

(Continued)

*Primary Examiner* — Olivia M. Wise
*Assistant Examiner* — Sharon M. Papciak
(74) *Attorney, Agent, or Firm* — Ballard Spahr LLP

(57) ABSTRACT

The present invention is directed to the field of phage therapy for the treatment and control of bacterial infections, in particular respiratory bacterial infections such as bacterial pneumonia. More specifically, the present invention is directed to novel bacteriophage strains, and products and cocktails thereof, including F99/10, F110/10, F27/12, Psa_F83/13, Psa_F95/13, F391/08, Kle_F92/15, Kle_F105/15, Kle_F134/15, Kle_F141/15, as well as variants thereof; and methods of using same in the treatment and prevention of bacterial infections, including respiratory infections caused by, e.g., *Pseudomonas aeruginosa* and/or *Klebsiella pneumoniae*. The cocktails are used as pharmaceutical compositions either alone or in further combination with other therapies, e.g., antibiotics or other standard and non-standard therapies for respiratory infections.

21 Claims, 30 Drawing Sheets
Specification includes a Sequence Listing.

(56) References Cited

OTHER PUBLICATIONS

Alves, D.R. et al. 2016; first published Sep. 8, 2015. A novel bacteriophage cocktail reduces and disperses Pseudomonas aeruginosa biofilms under static and flow conditions. Microbial Biotechnology 9(1): 61-74. specif. pp. 61, 62, 63, 72.*

Miyata, R. et al. 2014. Characterization of a novel Pseudomonas aeruginosa bacteriophage, KPP25, of the family Podoviridae. Virus Research 189: 43-46. specif. pp. 43, 45.*

Kwan, T. et al. 2006. Comparative genomic analysis of 18 Pseudomonas aeruginosa bacteriophages. Journal of Bacteriology 188(3): 1184-1187. specif. pp. 1184, 1186.*

Golshahi, L. et al. 2010. In vitro lung delivery of bacteriophages KS4-M and KZ using dry powder inhalers for treatment of Burkholderia cepacia complex and Pseudomonas aeruginosa infections in cystic fibrosis. Journal of Applied Microbiology 110: 106-117. specif. pp. 106, 108, 109, 110.*

NCBI Blast nucleotide sequence search. SEQ ID Nos. 1, 3 and 5. Retrieved on Jan. 24, 2022. Downloaded from the internet: <https://blast.ncbi.nlm.nih.gov/Blast.cgi#sort_mark> pp. 1-15.*

International Search Report for PCT/PT2017/050028 dated Jul. 13, 2018.

Benjamin K Chan et al.: "Phage Cocktails and the Future of Phage Therapy", Future Microbiology, vol. 8, No. 6, Jun. 1, 2013, pp. 769-783.

Diana R. Alves et al.: "A Novel Bacteriophage Cocktail Reduces and Disperses P Seudomonas Aeru-ginosa Biofilms Under Static and Flow Conditions: Bacteriophages to Treat P. Aeruginosa Biofilms", Microbial Biotechnolog, vol. 9, mo. 1, Sep. 8, 2015, pp. 61-74.

* cited by examiner

FIG. 3 (cont.)

| Orf | Putative function | Orf | Putative function |
|---|---|---|---|
| 1 | tRNA1-Cys | 79 | Thymidylate synthase |
| 2 | tRNA2-Pro | 81 | Ribonucleotide diphosphate reductase beta subunit |
| 3 | tRNA3-Gly | 82 | Ribonucleotide diphosphate reductase alpha chain |
| 4 | tRNA-4-Phe | 139 | DNA recombination – mediator protein A |
| 5 | tRNA5-Glu | 144 | Nicotinamide phosphoribosyl transferase |
| 6 | Terminase large subunit | 146 | Phosphoribosyl pyrophosphate |
| 8 | Methyltransferase | 147 | ATPase |
| 11 | Major capsid protein | 148 | RNA ligase 7Tail attachment protein |
| 13 | RNA polymerase | 150 | Transcriptional regulator |
| 22 | Tape measure protein | 152 | Phosphoesterase |
| 26 | Base plate protein | 154 | Metal-dependent phosphohydrolase |
| 28 | Base plate related protein | 155 | Cell wall hydrolase |
| 30 | Tail fiber protein transporter | 157 | DNA ligase |
| 32 | Tail fiber protein | 158 | dCMP deaminase |
| 33 | Endolysin | 162 | HNH endonuclease |
| 35 | Filament protein | 169 | ATP-dependent protease subunit |
| 41 | Nucleoside triphosphate pyrophospholydrolase | 174 | tRNA6-Gln |
| 43 | RNA ligase | 175 | Trna7-Arg |
| 57 | DNA primase / helicase | 176 | HNH endonuclease |
| 58a,b | DNA polymerase | 177 | tRNA8-Lys |
| 59 | Endonuclease | 178 | tRNA9-Leu |
| 66 | Exodeoxyribonuclease | 179 | tRNA10-Ile |
| 67 | HNH nuclease | 180 | tRNA11-Asp |

FIG. 4 (cont.)

| Orf | Putative function |
|---|---|
| 15 | Tail length tape-measure protein |
| 19 | Terminase |
| 32 | Minorhead protein |
| 33 | Minorhead protein |
| 38 | Capsid and scaffold protein |
| 51 | Tail fiber protein |
| 53 | Tail protein containing transglycosylase |
| 57 | Baseplate protein |
| 59 | Tail fiber protein |
| 60 | Tail fiber component |
| 61 | Endolysin |
| 63 | DNA ligase |
| 64 | DNA – binding protein |
| 68 | DNA helicase |
| 69 | DNA helicase |
| 70 | DNA polymerase III alpha subunit |
| 71 | DNA polymerase III epsilon subunit |
| 72 | 3' – phosphatase, 5' – polynucleotide kinase |
| 74 | Thimidylate synthase complementing protein |
| 77 | Tail assembly protein |
| 82 | ATP-dependent exonuclease |
| 84 | Endonuclease |
| 89 | DNA primase |

FIG. 5 (cont.)

| Orf | Putative function |
|---|---|
| 1a,b | Central Tail hub |
| 2 | DNA polymerase |
| 3 | Replicative clamp |
| 5 | DEAD box helicase |
| 6 | RecB exonuclease |
| 10 | RecA |
| 12 | MazG protein |
| 14 | Replicative primase helicase |
| 24 | VSR endonuclease |
| 31 | Adenosine deaminase |
| 36 | Hollin |
| 37 | Endolysin |
| 38 | Rz protein |
| 39 | Small terminase subunit |
| 40 | Large terminase subunit |
| 41 | Portal protein |
| 42 | F-like head morphogenesis protein |
| 43 | Scaffold protein |
| 44 | Major capsid protein |
| 48 | Head Tail joining protein |
| 49 | Minor Tail protein |
| 50 | Major Tail tube protein |
| 51a,b | Tail chaperonin |
| 53 | Tape measure protein |

FIG. 6 (cont.)

| orf | Putative function | orf | Putative function |
|---|---|---|---|
| 8 | deoxynucleoside-6'-monophosphatase | 46 | NAD-dependent DNA ligase subunit A |
| 11 | receptor-binding tail protein | 49 | transcriptional co-activator |
| 13 | terminase large subunit | 55 | replication origin binding protein / helicase |
| 15 | portal protein | 59 | Sir2-like protein |
| 16 | Ig-like virion proteinp | 61 | anaerobic ribonucleoside-triphosphate reductase |
| 17 | prohead protease | 62 | phosphate starvation-inducible ATPase |
| 18 | major head protein precursor | 65 | Aerobic ribonucleoside diphosphate reductase, large sub unit |
| 22 | major tail protein | 66 | Aerobic ribonucleoside diphosphate reductase, small subunit |
| 23 | minor tail protein | 67 | dihydrofolate reductase |
| 26 | pore-forming tail tip protein | 68 | thymidylate synthase |
| 28 | tail protein | 71 | ribonuclease H |
| 29 | tail protein | 75 | metallopeptidase |
| 30 | minor tail protein | 76 | cell wall hydrolase |
| 31 | phage tail protein | 79 | tRNA1-Arg |
| 32 | deoxyUTP pyrophosphatase | 81 | trNA2-Met |
| 33 | flap endonuclease | 85 | tRNA3-Gln |
| 35 | DNA replication, recombination and repair | 86 | tRNA4-Glu |
| 36 | DNA replication, recombination and repair | 87 | tRNA5-Ala |
| 39 | ATP-dependent helicase | 88 | tRNA6-Leu |
| 41 | DNA polymerase | 90 | tRNA7-Ser |
| 42 | DNA replication primase | 91 | tRNA8-Ser |
| 43 | replicative DNA helicase | 92 | tRNA9-His |
| 44 | transcription factor | | |
| 45 | NAD-dependent DNA ligase, subunit B | | |

FIG. 6 (cont.)

| orf | Putative function |
|---|---|
| 93 | tRNA10-Arg |
| 94 | tRNA11-Gln |
| 95 | tRNA12-Met |
| 98 | tRNA13-Ile |
| 99 | tRNA14-Met |
| 100 | tRNA15-Val |
| 104 | tRNA16-Asp |
| 105 | tRNA17-Asn |
| 106 | tRNA18-Cys |
| 108 | tRNA19-Lys |
| 109 | tRNA20-Phe |
| 113 | tRNA21-Leu |
| 114 | tTNA22-Pro |
| 115 | tRNA23-Thr |
| 116 | tRNA24-Gly |
| 119 | tRNA25-Trp |
| 139 | deoxynucleoside-5'-monophosphatase |
| 140 | ATP-dependent Clp protease |
| 141 | holin |
| 142 | lysozyme |
| 144 | thioredoxin |
| 147 | serine/threonine protein phosphatase |

FIG. 7
(cont.)

| orf | Putative function | orf | Putative function |
|---|---|---|---|
| 2 | tRNA1-Met | 50 | 4-hydroxy-3-polyprenyl benzoate decarboxylase |
| 5 | Sensor histidine kinase | 52 | RNA polymerase sigma-54 factor |
| 6 | tRNA2-Gln | 58 | 6-phosphofructokinase |
| 7 | tRNA3-Glu | 62 | Deoxynucleoside monophosphate kinase |
| 8 | tRNA4-Ala | 63 | TP-dependent Clp protease proteolytic sub unit |
| 10 | tRNA5-Leu | 64 | holin |
| 11 | tRNA6-Ser | 65 | Endolysin |
| 12 | tRNA7-Ser | 68 | Thioredoxin |
| 13 | tRNA8-His | 71 | Serine/threonine protein phosphatase |
| 14 | tRNA9-Arg | 95 | Restriction endonuclease sub unit R |
| 15 | tRNA10-Glu | 100 | A2 protein |
| 16 | tRNA11-Met | 103 | DNA transfer protein |
| 19 | tRNA12-Ile | 105 | Deoxyucleoside-5'monophosphatase |
| 20 | tRNA13-Met | 107 | Receptor-binding protein |
| 21 | tRNA14-Val | 109 | Terminase large sub unit |
| 23 | ATP-dependent chaperoneC | 111 | Portal protein |
| 24 | Cilial-and flagella-associated protein | 112 | Major tail protein |
| 25 | tRNA15-Asp | 113 | Capsid and scaffold protein |
| 26 | tRNA16-Tyr | 114 | Major capsid protein |
| 27 | HNH nuclease domain-containing protein | 115 | Head completion protein |
| 28 | tRNA17-Asn | 118 | Tail fiber protein |
| 29 | tRNA18-Cys | 119 | Tail fiber protein |
| 31 | tRNA19-Lys | 122 | Tail length tape-measure pro |
| 32 | tRNA20-Phe | 124 | Tail length tape-measure pro |
| 36 | tRNA21-Lea | 125 | Tail fiber protein |
| 37 | tRNA22-Pro | 126 | Tail fiber protein |
| 38 | tRNA23-Thr | 127 | Tail fiber protein |
| 39 | tRNA24-Gly | 128 | Deoxyuridine 5'-triphosphate nucleoside |
| 41 | tRNA25-Trp | | |

FIG. 7
(cont.)

| orf | Putative function |
|---|---|
| 129 | Ribonuclease H |
| 130 | endonuclease |
| 131 | Recombination-related endonuclease |
| 132 | Recombinase |
| 133 | D11 protein |
| 135 | DNA helicase |
| 137 | DNA polymerase I |
| 138 | DNA primase |
| 139 | Replicative DNA helicase |
| 140 | D5 protein |
| 141 | NDP-dependent DNA ligase subunit B |
| 142 | NAD-dependent DNA ligase subunit A |
| 145 | SS DNA-binding transcriptional regulator |
| 147 | D3 protein |
| 149 | D2 protein |
| 151 | Replication origin binding protein |
| 155 | NAD-dependent protein deacetylase of SIR2 family |
| 157 | Ribonucleotide reductase of class III (anaerobic), large sub unit |
| 158 | Phosphate starvation-inducible protein |
| 161 | Ribonucleotide reductase of class Ia (aerobic), alpha sub unit |
| 162 | Ribonucleotide reductase of class Ia (aerobic), beta sub unit |
| 163 | Dihydrofolate reductase |
| 164 | Thymidylate synthase |
| 167 | Ribonuclease HI |
| 171 | Metallopeptidase |
| 172 | Cellwall lydrolyse |
| 176 | tRNA26-Arg |

FIG. 8 (cont.)

| orf | Putative function |
|---|---|
| 1a, b | Sigma factor for late transcription |
| 6 | alpha-glucosyltransferase |
| 7 | recombination endonuclease sub unit |
| 8 | Recombination endonuclease sub unit |
| 10 | RNA polymerase binding protein |
| 11 | Sliding clamp DNA polymerase accessory protein |
| 12 | Replication factor C small sub unit phage DNA polymerase clamp loader sub unit |
| 13 | DNA polymerase clamp loader sub unit |
| 14 | Transcriptional repressor protein |
| 15 | DNA polymerase |
| 18 | dCMP hydroxymethylase |
| 19 | MobC homing endonuclease |
| 20 | Putative glycosyltransferase |
| 22 | RecA-like recombination protein |
| 23 | Head vertex assembly chaperone |
| 24 | DNA helicase |
| 29 | DNA primase |
| 31 | dCTP pyrophosphatase |
| 33 | Small outer capsid protein |
| 37 | NAD-protein ADP-ribosyltransferase |
| 38 | anti-termination |
| 40 | DNA helicase |
| 42 | exonuclease A |
| 48 | regulatory protein, FmdB family |
| 51 | DNA topoisomerase large subunit |
| 55 | rIIA lysis inhibitor |
| 56 | rIIB protein |
| 58 | endonuclease IV |
| 61 | nucleoid disruption protein |
| 64 | Topoisomerase II medium subunit |
| 66 | Transcriptional regulator of middle promoters [Klebsiella phage KPV15] |
| 70 | anti-restriction nuclease |
| 71 | anti-restriction nuclease |
| 76 | anti-sigma 70 protein |
| 77 | holin |
| 79 | L-shaped tail fiber protein |
| 80 | huge connector of long tail fiber distal connector |

FIG. 8 (cont.)

| orf | Putative function | orf | Putative function | orf | Putative function |
|---|---|---|---|---|---|
| 81 | Huge connector of long tail fiber proximal connector | 140 | DNA helicase | 176 | DNA end protector protein |
| 82 | Long tail fiber distal sub unit | 141 | RNA-DNA and DNA-DNA helicase, ATPase | 177 | Tail completion and sheath stabilizer protein |
| 83 | ribonuclease H | 142 | Inhibitor of prohead protease | 178 | dNMP kinase |
| 84 | dsDNA binding protein | 143 | head outer capsid protein | 185 | tRNA1 Type Tyr |
| 85 | Late promoter transcription accessory protein | 144 | DNA primase-helicase sub unit | 186 | tRNA2 Type Lys |
| 86 | DNA helicase loader protein | 147 | RNA ligase | 187 | tRNA3 Type Asn |
| 87 | single-stranded DNA binding protein | 149 | Capsid vertex protein | 188 | tRNA4 Type Asp |
| 93 | dihydrofolate reductase | 150 | Major head protein | 189 | tRNA5 Type Met |
| 95 | thymidylate synthase ribonucleoside-diphosphate | 151 | Prohead core protein prohead assembly (scaffolding) | 190 | tRNA6 Type Gln |
| 98 | ribonucleoside-diphosphate reductase | 152 | Protein and protease | 191 | tRNA7 Type His |
| 99 | ribonucleotide reductase of class Ia (Aerobic) beta sub unit | 153 | Capsid and scaffold Protein | 192 | tRNA8 Type Ser |
| 100 | endonuclease II | 154 | Prohead core protein | 193 | tRNA9 Type Ile |
| 101 | RNA ligase | 155 | Portal vertex of the head | 194 | tRNA 10 Type Trp |
| 102 | Inhibitor of host transcription | 156 | Tail tube protein | 195 | tRNA 11 Type Gly |
| 103 | spanin Rz | 157 | Tail sheath protein | 196 | tRNA 12 Type Pro |
| 104 | o-spanin | 158 | Terminase DNA packaging enzyme large sub unit | 204 | tRNA 14 Type Arg |
| 106 | Polynucleotide 5'-khase, 3'- | 159 | Terminase small sub unit | 205 | tRNA 15 Type Leu |
| 110 | deoxycytidylate deaminase | 160 | Proximal tail sheath stabilization protein | 206 | tRNA 16 Type Thr |
| 113 | Head assembly chaperone protein | 161 | neck protein | 215 | androxy hydrobase |
| 114 | Lysis inhibitor accessory protein | 162 | neck protein | 217 | lysozyme site-specific RNA |
| 126 | DNA ligase | 163 | fibritin neck whiskers protein | 226 | endonuclease valyl-tRNA synthetase |
| 128 | RNA polymerase-ADP-ribosyl transferase | 164 | short tail fiber | 228 | modifier site-specific intron-like |
| 130 | tail assembly protein | 165 | baseplate wedge sub unit and tail pin | 232 | DNA endonuclease |
| 131 | Putative baseplate tail tube cap | 166 | baseplate wedge | 233 | thymidine kinase |
| 132 | Baseplate hub sub unit tape measure protein | 167 | baseplate wedge tail fiber connector | 237 | RI lysis inihibtion regulator |
| 133 | Base plate distal hub sub unit | 168 | baseplate wedge subunit | 251 | thioredoxin |
| 134 | Baseplate hub sub unit | 169 | baseplate wedge initiator | | |
| 135 | Baseplate hub assembly catalyst | 170 | baseplate wedge subunit | | |
| 136 | Baseplate hub assembly chaperone | 173 | baseplate hub sub unit and tail lysozyme | | |
| 137 | Baseplate hub subunit | 174 | baseplate wedge subunit | | |
| 138 | Recombination, repair and ssDNA binding protein | 175 | head completion protein | | |

FIG. 9
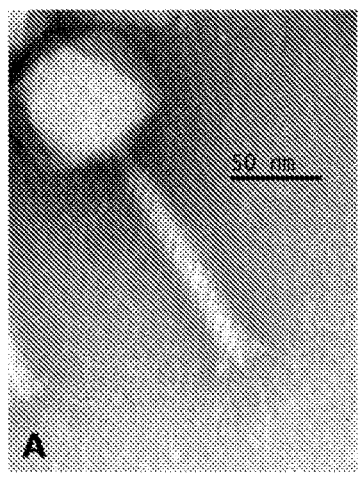 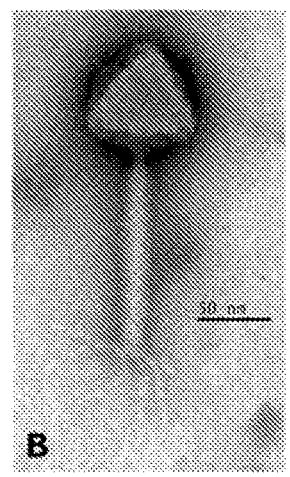 
F99/10: *Myoviridae*  
Phage size:  
Capsid: 79.9±3.7 nm  
Tail length: 131.9±3.0 nm
F27/12: *Myoviridae*  
Phage size:  
Capsid: 76.8±2.3 nm  
Tail length: 141.1±3.3 nm
Psa_F95/13: *Siphoviridae*  
Phage size:  
Capsid: 51.9±2.5 nm  
Tail length: 156±3.0nm FIG. 10
F391/08: *Siphoviridae*  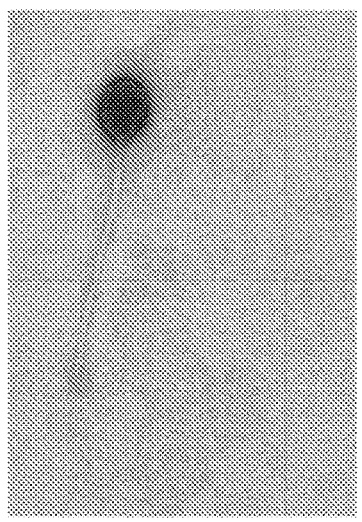
Kle_F92/15: *Siphoviridae*  
Kle_F105/15: *Myoviridae*  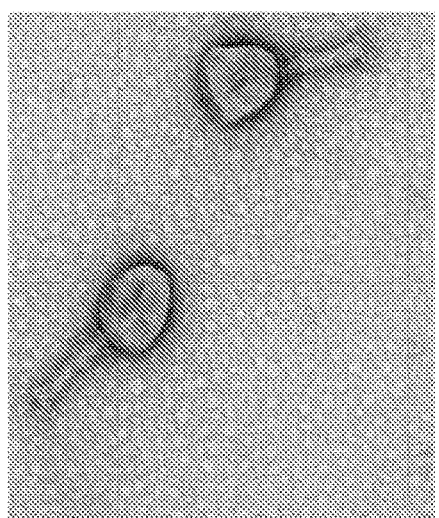
A
Phage size:
Capsid: 60.8±1.9 nm
Tail length: 223.5±10.9 nm
B
Phage size:
Capsid: 71.6±4.8 nm
Tail length: 170.0±22.1 nm
C
Phage size:
Capsid: 102.1±2.9 nm
Tail length: 95.9±4.5 nm

BACTERIOPHAGE COMPOSITIONS COMPRISING RESPIRATORY ANTIBACTERIAL PHAGES AND METHODS OF USE THEREOF

SEQUENCE LISTING

The instant application contains a Sequence Listing which has been submitted with the priority document in ASCII format via EFS-Web and is hereby incorporated by reference in its entirety. Said ASCII copy, created on Oct. 28, 2016, is named 14116_105017P_SL.txt and is 2,217,676 bytes in size.110

1. RELATED APPLICATIONS

This application claims priority from U.S. Provisional Application No. 62/430,113, filed on Dec. 5, 2016, the contents of which are hereby incorporated by reference in their entirety.

2. FIELD OF THE INVENTION

The present invention is directed to the field of phage therapy for the treatment and control of bacterial infections, in particular respiratory bacterial infections such as bacterial pneumonia. More specifically, the present invention is directed to novel bacteriophage strains, and products and cocktails thereof, including F99/10, F27/12, Psa_F95/13, F391/08, Kle_F92/15, Kle_F105/15, Kle_F134/15, Kle_F141/15, as well as variants thereof; and methods of using same in the treatment and prevention of bacterial infections, including respiratory infections caused by, e.g., *Pseudomonas aeruginosa* and/or *Klebsiella pneumoniae*. The cocktails are used as pharmaceutical compositions either alone or in further combination with other therapies, e.g., antibiotics or other standard and non-standard therapies for respiratory infections.

3. BACKGROUND

Bacteriophages (phage) are viruses that specifically infect and lyse bacteria. Phage therapy, a method of using whole phage viruses for the treatment of bacterial infectious diseases, was introduced in the 1920s by Felix d'Herelle. With the development of antibiotics in the 1940s, however, interest in phage-based therapeutics declined in the Western world. One of the most important factors that contributed to this decline was the lack of standardized testing and methods of production. The failure to develop industry wide standards for the testing of phage therapies interfered with the documentation of study results, leading to a perceived lack of efficacy, as well as problems of credibility, regarding the value of phage therapy. Another problem in phage production related to the purity grade of commercial preparations of phage, with preparations containing undesired bacterial components, e.g., endotoxins. Accordingly, adverse events were often associated with the preparations, particularly in patients receiving them intravenously.

Nevertheless, in Eastern Europe and the former Soviet Union, where access to antibiotics was limited, the development and use of phage therapy continued jointly with, or in place of, antibiotics. Further, with the rise of antibiotic resistant strains of many bacteria, interest in phage-based therapeutics has returned in the Western world. That is, even though novel classes of antibiotics may be developed, the prospect that bacteria will eventually develop resistance to the new drugs has intensified the search for non-chemotherapeutic means for controlling, preventing, and treating bacterial infections.

Phage therapy, and phage cocktails in particular, present an alternative to antibiotics for the treatment of bacterial infections, and in particular, to respiratory infections, including nosocomial pulmonary infections. Respiratory infections account for more than 4 million deaths annually. Hospital-acquired bacterial pneumonia (HABP) is an acute pulmonary infection and is one of the most frequent type of infections acquired in intensive care unit settings and is associated with increased mortality (ranging from 33 to 41%) (Guzman-Herrador B, et al., 2014, *J Hosp Infect* 86(1):53-56). Nosocomial pulmonary infections are typically caused by methicillin-resistant *Staphylococcus aureus* (MRSA), Gram-negative Enterobacteriaceae, such as *Klebsiella pneumoniae*, or Gram-negative non-Enterobacteriacea, such as *Pseudomonas aeruginosa* and *Acinetobacter* species (Quartin A A, et al., 2013, *BMC Infect Dis* 13:561-566; and Di Pasuale M, et al., 2014, *Crit Care Med* 42(2): 303-312).

Antibiotherapy is routinely used in HABP, however the therapeutic options for the multi-resistant (MDR) bacteria, especially Gram-negative bacteria, are scarce. No new classes of drugs have been introduced recently, and the few options currently available include colistin, tigecycline, and fosfomycin. For severe nosocomial infections, there are very few antibiotic options (Orsi G B, et al., 2011, *Expert Rev Anti Infect Ther* 9(8):653-679).

Aerosolization of antibiotics can lead to higher antibiotic delivery to the lung parenchyma, compared with intravenous administration of the antibiotic (Luyt C E, et al., 2009, *Crit Care* 13(6):R200). However, to date, there are no clear clinical benefits of using aerosolized antibiotics, like colistin, in the treatment of lung infections, due to the side effects from direct antibiotic toxicity on airways and lung parenchyma. These include, for example, mucosa irritation, as well as side effects caused by systemic absorption of the antibiotics, such as renal toxicity of aminoglycosides and polymyxins (Luyt C E, et al., 2013, *Expert Rev Anti Infect Ther* 11(5):511-521; and Quon B S, et al., 2014, *Ann Am Thorac Soc* 11(3):425-434).

Different studies have attempted to treat bacterial lung infections using bacteriophages administered via different routes (Hoe S, et al., 2013, *J Aerosol Med Pulm Drug Deliv* 26:317-335; Morello E. et al., 2011, *PLoS One* 6(2): e16963; and Debarbieux L, et al., 2010, *J Infect Dis* 201(7): 1096-1104). However, there is little published evidence of experimental studies with the aerosolized bacteriophages curing established infections (Ryan E M, et al., 2011, *J Pharm Pharmacol* 63:1253-1264), Previously published studies have not assessed the effects of the aerosolization of bacteriophages in established infections, mostly examining outcomes after only a few hours of infection (Wilson K R, et al., 200, Microbiology 153(Pt 4):968-979; and Alemayehu D. et al., 2012, MBio 3 (2):e00029-12). Moreover, there are few phage cocktails with antimicrobial activity against different bacteria, possibly because of the difficulty in combining different specificities of phage while maintaining storage stability.

Thus there remains a need to develop novel phage products as therapeutic and/or prophylactic agents for use in vivo against pathogenic bacteria, in particular, pulmonary bacteria. There also is a need for better treatments, particularly aerosolized treatments, for respiratory infections, preferably a hospital-acquired bacterial pneumonia or infection associated with cystic fibrosis or ventilated-acquired pneumonia.

In particular, there is a need for bacteriophage cocktails capable of lysing bacteria responsible for nosocomial respiratory infections, including *Pseudomonas aeruginosa* and/or *Klebsiella pneumonia* bacteria. This application addresses these and other needs.

4. SUMMARY OF THE INVENTION

Provided are novel *Pseudomonas aeruginosa* and *Klebsiella pneumonia* bacteriophage and their use in the treatment of bacterial infections. Pharmaceutical compositions comprising a bacteriophage disclosed herein, or combinations of two or more of the bacteriophage described herein, may be used in the treatment, management or prevention of a bacterial infection, particularly a *Pseudomonas aeruginosa* and/or *Klebsiella pneumonia* infection. Such pharmaceutical compositions may be particularly useful in the treatment, management or prevention of respiratory infections and the compositions may be formulated for pulmonary delivery.

One aspect of the invention relates to novel *Pseudomonas aeruginosa* and *Klebsiella pneumonia* bacteriophages. In some embodiments, provided are purified bacteriophage comprising a nucleic acid having a nucleotide sequence with at least 97% sequence identity to SEQ ID NO: 1, 2, or 3 (corresponding to *P. aeruginosa* phages F99/10, F110/10, or F27/12, respectively) and having antibacterial activity against *P. aeruginosa*. In some embodiments, the invention provides a purified bacteriophage comprising a nucleic acid having a nucleotide sequence with at least 95% sequence identity to SEQ ID NO:4 (corresponding to *P. aeruginosa* phage F83/13), or least 97% sequence identity to SEQ ID NO:5 (corresponding to *P. aeruginosa* phage F95/13) and having antibacterial activity against *Pseudomonas aeruginosa*. In preferred embodiments, the bacteriophage comprises a nucleic acid having the nucleotide sequence selected from the group consisting of SEQ ID NO:1 (F99/10), SEQ ID NO:2 (F110/10), SEQ ID NO:3 (F27/12), SEQ ID NO:4 (F83/13), SEQ ID NO:5 (F95/13), SEQ ID NO:7 (F92/15), SEQ ID NO:8 (F105/15), SEQ ID NO:9 (F134/15), and SEQ ID NO:10 (F141/15). It will be appreciated that these foregoing nucleotide sequences comprise or consist of the genome of the described bacteriophage.

In some aspects, the bacteriophage genomes indicated above correspond to a first or main contig sequence, where there remain additional contig sequences (usually much shorter sequences) relating to the comple genome of the phage, for use in finalizing the phage genome Specifically, SEQ ID NO:5 corresponds to a first contig sequence of 43,020 base pairs. SEQ ID NOs:634-636 correspond to related second, third, and fourth contigs, respectively.

SEQ ID NO:7 corresponds to a first contig sequence of 29,868 base pairs. SEQ ID NOs:637-653 correspond to related second to 18th contigs, respectively.

SEQ ID NO:8 corresponds to a first contig sequence of 17,247 base pairs. SEQ ID NOs:654-698 correspond to related second to 46th contigs, respectively.

SEQ ID NO:9 corresponds to a first contig sequence of 10,090 base pairs. SEQ ID NOs:699-747 correspond to related second to 50th contigs, respectively.

SEQ ID NO:10 corresponds to a first contig sequence of 32,105 base pairs. SEQ ID NOs:748-749 correspond to related second and third contigs, respectively.

In some embodiments, the invention provides a purified bacteriophage comprising a nucleic acid having a nucleotide sequence with at least 90% sequence identity to SEQ ID NO:7 (corresponding to *K. pneumoniae* phage F92/15), or at least 99% sequence identity to SEQ ID NO:8 (corresponding to *K. pneumoniae* phage F105/15), at least 98% sequence identity to SEQ ID NO:9 (corresponding to *K. pneumoniae* phage F134/15), or at least 95% sequence identity to SEQ ID NO:10 (corresponding to *K. pneumoniae* phage F141/15), and having antibacterial activity against *K. pneumoniae*.

Another aspect of the invention relates to pharmaceutical compositions comprising a bacteriophage or phage product of the invention and a pharmaceutically acceptable carrier. In some embodiments, the pharmaceutical composition further comprises one or more additional bacteriophage or phage products having antibacterial activity against *P. aeruginosa* and/or *K. pneumonia*. In some embodiments, the composition is formulated in a dosage form in which the bacteriophage is present in an amount to provide a multiplicity of infection (MOI) of about 1 to about 10 upon administration of the composition to a subject in need thereof. In preferred embodiments, the composition is formulated for administration as an aerosol.

Another aspect of the invention relates to compositions comprising two or more different purified bacteriophages in a cocktail combination. In some embodiments, the composition is a pharmaceutical composition comprising at least two different phage, each comprising a nucleic acid having a nucleotide sequence with at least 97% sequence identity to SEQ ID NO:1, or 3 (corresponding to *P. aeruginosa* phages F99/10, or F27/12, respectively), at least 97% sequence identity to SEQ ID NO:5 (corresponding to *P. aeruginosa* phage F95/13), at least 90% sequence identity to SEQ ID NO:6 (corresponding to *K. pneumonia* phage F391/08), at least 90% sequence identity to SEQ ID NO:7 (corresponding to *K. pneumonia* phage F92/15), at least 99% sequence identity to SEQ ID NO:8 (corresponding to *K. pneumonia* phage F105/15), at least 98% sequence identity to SEQ ID NO:9 (corresponding to *K. pneumonia* phage F134/15), or at least 95% sequence identity to SEQ ID NO: 10 (corresponding to *K. pneumonia* phage F141/15), and having antibacterial activity against *P. aeruginosa* or *K. pneumoniae*. In particularly preferred embodiments, the bacteriophage comprises a nucleic acid having the nucleotide sequence selected from the group consisting of SEQ ID NO:1 (F99/10), SEQ ID NO:3 (F27/12), SEQ ID NO:5 (F95/13), SEQ ID NO:6 (F391/08), SEQ ID NO:7 (F92/15), SEQ ID NO:8 (F105/15), SEQ ID NO:9 (F134/15), and SEQ ID NO:10 (F141/15).

In some embodiments, the composition comprises three different bacteriophages each comprising a nucleic acid molecule having a nucleotide sequence with at least 97% sequence identity to SEQ ID NO:1, 3, or 5 (corresponding to phages F99/10, F27/12, or F95/13, respectively), and having antibacterial activity against *P. aeruginosa*. In some preferred embodiments, the composition comprises five different bacteriophages, each comprising a nucleic acid molecule having a nucleotide sequence with at least 97% sequence identity to SEQ ID NO:1, or 3, at least 95% sequence identity to SEQ ID NO:4 (F83/13), or at least 97% sequence identity to SEQ ID NO:5 (F95/13), and having antibacterial activity against *P. aeruginosa*. In still more preferred embodiments, the composition is formulated for administration as an aerosol and for pulmonary delivery.

Another aspect of the invention relates to methods for treating or reducing the occurrence of or managing a bacterial infection in a subject in need thereof comprising administering to the subject a therapeutically or prophylactically effective amount of a pharmaceutical composition of the invention, as well as to use of the pharmaceutical composition in this regard. In some embodiments, the bacterial infection is caused by a *P. aeruginosa* and/or a *K. pneumoniae* bacterial strain, including a bacterial strain showing resistance to one or more known antibiotics and/or capable of forming a biofilm. In preferred embodiments, the bacterial infection to be treated, or reduced in occurrence, is a respiratory infection, more preferably a hospital-acquired bacterial pneumonia or a respiratory infection associated with cystic fibrosis. In particularly preferred embodiments, the composition is administered as an aerosol to the lungs. In some embodiments, the composition is re-administered about 4-6 hours after initial administration.

Another aspect of the invention relates to a method for diagnosing the causative agent of a bacterial infection comprising (i) culturing a sample, such as a swab or sputum or other sample appropriate for culturing the bacteria causing the infection, from a patient; (ii) contacting the culture of step (i) with a bacteriophage or phage product of the invention; and (iii) monitoring for evidence of growth or lysis of the culture, where evidence of lysis of the culture indicates that the culture comprises a bacterial strain known to be susceptible to the bacteriophage or phage product used in step (ii). In some embodiments, the sample is a tissue biopsy or swab collected from the respiratory tract of the patient. For example, the sample may comprise bronchoalveolar lavage or bronchial secretions.

Still another aspect of the invention provides a method for reducing or inhibiting colonization or growth of bacteria on a surface comprising contacting the surface with a bacteriophage or phage product of the invention. In some embodiments, the surface is a mucus membrane of a mammal, preferably a mucus membrane of the respiratory tract of a human. In some embodiments, the surface is a non-biological surface, preferably the surface of a hospital apparatus or a piece of hospital equipment, more preferably a surgical apparatus or piece of surgical equipment.

Definitions

As used herein, the term "isolated" in the context of nucleic acid molecules refers to a first nucleic acid molecule which is separated from other nucleic acid molecules which are present in the natural source of the first nucleic acid molecule. An "isolated" nucleic acid molecule, such as an "orf" or a phage genome, is substantially free of other cellular material, or culture medium when produced by recombinant techniques, or substantially free of chemical precursors or other chemicals when chemically synthesized; and may be free of other DNA or other genomic DNA molecules, e.g., where it has been purified and isolated from other clones in a nucleic acid library or from isolated phage. Further, "isolated" genomic DNA is substantially free of other viral or cellular material, or culture medium when produced by recombinant techniques or isolated from phage, or substantially free of chemical precursors or other chemicals when chemically synthesized, and may be free of other DNA or other genomic DNA molecules, e.g., where it has been purified and isolated from preparations containing other bacteriophage or cellular material.

The term "purified" with respect to a bacteriophage means that the phage has been measurably increased in concentration by any purification process, including but not limited to, isolation from the environment or culture, e.g., isolation from culture following propagation and/or amplification, centrifugation, etc., thereby partially, substantially, nearly completely, or completely removing impurities, such as host cells and host cell components. One of skill in the art will appreciate the amount of purification necessary for a given use. For example, a purified phage meant for use in therapeutic compositions intended for administration to humans ordinarily must be of high purity in accordance with regulatory standards and good manufacturing processes.

The term "purified" with respect to a peptide, polypeptide, fusion protein, or nucleic acid molecule means that the peptide, polypeptide, fusion protein, or nucleic acid molecule has been measurably increased in concentration by any purification process, including but not limited to, column chromatography, HPLC, precipitation, electrophoresis, etc., thereby partially, substantially, nearly completely, or completely removing impurities, such as precursors or other chemicals involved in preparing the peptide, polypeptide, fusion protein, or nucleic acid molecule. One of skill in the art will appreciate the amount of purification necessary for a given use. For example, isolated and purified genomic DNA or protein or polypeptides meant for use in therapeutic compositions intended for administration to humans ordinarily must be of high purity in accordance with regulatory standards and good manufacturing processes.

As used herein the terms "bacteriophage products" or "biologically active bacteriophage products" refer to proteins, or fragments or variants thereof, as well as nucleic acids encoding same, which have been isolated or derived from a bacteriophage of the invention and which retain a biological function or activity associated with the bacteriophage from which it was isolated or derived (e.g., antibacterial activity such as lytic cell killing).

As used herein, the term "variant" in the context of nucleotide sequences refers to a nucleotide sequence that comprises or consists of a nucleotide sequence having a sequence identity of at least 70%, 75%, 80%, 85%, 90%, 93%, 94%, 95%, 96%, 97%, 98%, or at least 99% with a reference nucleic acid sequence. A variant may be selected that maintains one or more functions of the reference nucleic acid sequence. For example, a variant bacteriophage may exhibit at least one biological activity, e.g., antibacterial activity, such as lytic killing activity, of the bacteriophage from which it is derived. One of skill in the art will appreciate that nucleic acid replication in phages is less than 100% accurate, such that a given phage will show at least 1% variation as it replicates, including during its production as an antibiotic agent. The expected genome variation during manufacture and use of phages may result in progeny that are variants having at least about 85%, 90%, 95%, 96%, 97%, 98%, or 99% sequence identity to the nucleotide sequence of the parent genome. It follows that, in certain embodiments, the bacteriophage of the invention comprises or consists of a genome having at least about 85%, 90%, 95%, 96%, 97%, 98%, or at least 99% sequence identity to the nucleotide sequence of the parent phage, while retaining antibacterial activity against the target (host) bacteria of the parent phage.

For example, in certain embodiments, the bacteriophage of the invention comprises or consists of a nucleic acid having a nucleotide sequence with at least about 95%, 96%, or 97% sequence identity to SEQ ID NO:1 (F99/10), to SEQ ID NO:3 (F27/12), or to SEQ ID NO:5 (F95/13), while retaining antibacterial activity against *Pseudomonas aeruginosa*. In certain embodiments, the bacteriophage of the invention comprises or consists of a nucleic acid having a nucleotide sequence with at least about 95%, 96%, 97%, 98%, or 99% sequence identity to SEQ ID NO:8 (F105/15) or to SEQ ID NO:9 (F134/15), while retaining antibacterial activity against *Klebsiella pneumoniae*.

The term "progeny" with reference to any of the novel phages herein means bacteriophage replicates containing descendents produced according to subculture of a bacteriophage of a specific nucleic acid identified herein, or by a method known to those ordinarily skilled in the art, or bacteriophages having a RFLP (Restriction fragment length polymorphism) DNA profile substantially equivalent to the bacteriophage of a specific nucleic acid identified herein. The term "have a substantially equivalent or equal RFLP" is expressed to represent a variability between organisms according to the method suggested by Tenover et al. (Tenover, F. C. et al. Interpreting Chromosomal DNA Restriction Patterns Produced by Pulsed-Field Gel Electrophoresis: Criteria for Bacterial Strain Typing. *J. Clin. Microbiol* 33:2233-2239 (1995)). Tenover et al. suggest an acceptable level of variability with a proviso that genome of identical propagated organisms is restricted with restriction enzymes and then electrophoresized. According to the standard suggested by Tenover et al, a progeny having an equivalent RFLP DNA profile may be considered as a bacteriophage substantially equivalent to the bacteriophage of a specific nucleic acid identified herein, that is, substantially the equivalent of a bacteriophage comprising a nucleic acid sequence having the nucleotide sequence of any of SEQ ID NOs:1-10.

As used herein, a "contig" refers to a nucleotide sequence that has been assembled based on merging overlapping-reads of fragments of a larger sequence (e.g., corresponding to a genome of a bacteriophage) into a set of non-overlapping regions to create the contig. Initially, more than one contig may be obtained based on, e.g., numbers of mismatches (variation at nucleotide positions) allowed, that are due to sequencing error or biological variation, as discussed above. The contigs thus represent different arrangements of overlapping sequences. Contigs can be further analyzed and rearranged to generate all or most of a complete sequence, e.g., the complete genomic sequence. For example, the genome of phage F95/13 is represented by the nucleic acid corresponding to SEQ ID NO: 5 (corresponding to a first contig sequence of 43,020 base pairs) as well as the nucleic acid sequences corresponding to SEQ ID NOs:634-636 (corresponding to related second, third, and fourth contigs, respectively, for the full genomic sequence of this phage).

As used herein, the term "host cell" refers to the particular subject cell transfected with a nucleic acid molecule and the progeny or potential progeny of such a cell that contains the nucleic acid molecule or chromosomally integrated version thereof. Progeny of such a cell may not be identical to the parent cell transfected with the nucleic acid molecule due to mutations or environmental influences that may occur in succeeding generations or integration of the nucleic acid molecule into the host cell genome. "Host cell" also refers to a cell, such as a bacterial cell, infected with bacteriophages, e.g., whole phages, where the bacteriophages live and replicate. For the generation of bacteriophage, the host cell may or may not be of the same species or strain from which the bacteriophage was isolated or cultured.

As used herein, the term "fragment" refers to a peptide or polypeptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least contiguous 200 amino acid residues, or at least contiguous 250 amino acid residues of the amino acid sequence of a full-length protein. In a specific embodiment, the fragment is a functional fragment in that it retains at least one function of the protein from which it is isolated, e.g., retaining antibacterial activity, such as lytic cell killing.

As used herein, the term "in combination" or "in further combination" or "further in combination" refers to the use of an additional prophylactic and/or therapeutic agent with a bacteriophage or phage product of the invention, including a phage cocktail of different bacteriophages of the invention. The use of the term "in combination" does not restrict the order in which prophylactic and/or therapeutic agents are administered to a subject. A first prophylactic or therapeutic agent can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second prophylactic or therapeutic agent (different from the first prophylactic or therapeutic agent) to a subject.

As used herein, the term "boost" or "booster" refers to subsequent, repeat use of the same or substantially the same prophylactic and/or therapeutic agent, such as repeat doses of a bacteriophage, phage product, or phage cocktail of the invention. The prophylactic or therapeutic agent can be first administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before) the second administration of the same or substantially the same prophylactic or therapeutic agent to a subject.

As used herein, the terms "prophylactic agent" and "prophylactic agents" refer to an agent, such as a bacteriophage, phage product, or phage cocktail of the invention, which can be used in the prevention, management, control, or reduction in the incidence of, one or more symptoms of a disease or disorder, in particular, a disease or disorder associated with a bacterial infection, more particularly, a disease or disorder associated with a respiratory bacterial infection such as hospital-acquired bacterial pneumonia or a respiratory bacterial infection associated with cystic fibrosis.

As used herein, the terms "therapeutic agent" and "therapeutic agents" refer to an agent, such as a bacteriophage, phage product, or phage cocktail of the invention, that can be used in the treatment, management, or control of one or more symptoms of a disease or disorder, in particular, a disease or disorder associated with a bacterial infection, more particularly, a disease or disorder associated with a respiratory bacterial infection such as hospital-acquired bacterial pneumonia or a respiratory bacterial infection associated with cystic fibrosis.

As used herein, the terms "treat", "treatment" and "treating" refer to obtaining a therapeutic benefit in a subject receiving a pharmaceutical composition. With respect to achieving a therapeutic benefit, the object is to eliminate, lessen, decrease the severity of, ameliorate, or slow the progression of the symptoms or underlying cause (e.g., bacterial infection) associated with the pathological condition or disorder. A "therapeutically effective amount" refers to that amount of a therapeutic agent, such as a bacteriophage or phage product in a pharmaceutical composition of the invention, sufficient to achieve at least one therapeutic benefit in a subject receiving the pharmaceutical composition.

As used herein, the terms "prevent", "prevention" and "preventing" refer to obtaining a prophylactic benefit in a subject receiving a pharmaceutical composition. With respect to achieving a prophylactic benefit, the object is to delay, reduce the incidence of, or prevent the symptoms or underlying cause (e.g., bacterial infection) associated with the pathological condition or disorder. A "prophylactically effective amount" refers to that amount of a prophylactic agent, such as a bacteriophage or phage product in a pharmaceutical composition of the invention, sufficient to achieve at least one prophylactic benefit in a subject receiving the pharmaceutical composition.

As used herein, the terms "antibacterial activity" and "antimicrobial activity", with reference to a bacteriophage or bacteriophage product (e.g., a phage protein), or a variant or fragment thereof, are used interchangeably to refer to the ability to kill and/or inhibit the growth or reproduction of a microorganism, in particular, the bacteria of the species or strain that the bacteriophage infects. In certain embodiments, antibacterial activity is assessed by culturing bacteria, e.g., Gram-negative bacteria (e.g., *P. aeruginosa* or *K. pneumoniae*) according to standard techniques (e.g., in liquid culture or on agar plates), contacting the culture with a bacteriophage, phage protein, or variant thereof of the invention, or with a cocktail of bacteriophages, phage proteins, or variants thereof, and monitoring cell growth after said contacting. For example, in a liquid culture, the bacteria may be grown to an optical density ("OD") representative of a mid-point in exponential growth of the culture; the culture is exposed to one or more concentrations of one or more bacteriophages of the invention, bacteriophage products, or variants thereof, and the OD is monitored relative to a control culture. Decreased OD relative to a control culture is representative of phage(s) or phage product(s) exhibiting antibacterial activity (e.g., lytic killing activity). Similarly, bacterial colonies can be allowed to form on an agar plate, the plate exposed to one or more bacteriophages or phage products of the invention, or variants thereof, and subsequent growth of the colonies evaluated related to control plates. Decreased size of colonies, or decreased total numbers of colonies, indicate phage(s) or phage product(s) with antibacterial activity.

BRIEF DESCRIPTION OF THE FIGURES

FIGS. 9A-9C illustrates morphological characteristics of bacteriophage F99/10 (FIG. 9A), F27/12 (FIG. 9B), and Psa_F95/13 (FIG. 9C) using transmission electron microscopy.

FIGS. 10A-10C illustrates morphological characteristics of bacteriophage F391/08 (FIG. 10A), Kle_F92/15 (FIG. 10B), and Kle_F105/15 (FIG. 10C) using transmission electron microscopy.

DETAILED DESCRIPTION

The present invention is directed to phage therapy for the treatment and control of bacterial infections, in particular respiratory bacterial infections such as bacterial pneumonia and respiratory infections associated with cystic fibrosis or ventilated-acquired pneumonia. One aspect of the invention relates to novel bacteriophage strains, including the *P.*

*aeruginosa* phages F99/10, F27/12, Psa_F95/13; and the *K. pneumonia* phages Kle_F92/15, Kle_F105/15, Kle_F134/15, and Kle_F141/15, as well as variants thereof and products thereof, including useful phage proteins and nucleic acids encoding same. Another aspect of the invention relates to cocktail compositions of one or more bacteriophage and/or phage products of the invention, as well as combinations with other phage, including F391/08 (previously disclosed in PCT/PT2011/000031). Still another aspect relates to pharmaceutical compositions of the phage(s) and/or phage product(s), as well as methods of using same in the treatment and prevention of bacterial infections, in particular, respiratory infections caused by *P. aeruginosa* and/or *K. pneumoniae*. Still other aspects of the invention relate to use of the phages, phage products, and combinations thereof, as diagnostic tools and disinfective agents.

Bacteriophage and Variants Thereof

One aspect of the invention relates to novel *Pseudomonas aeruginosa* bacteriophages that target a number of strains of *P. aeruginosa*. *P. aeruginosa* is a common Gram-negative rod-shaped bacterium found in soil, water, skin flora and most man-made environments. It thrives not only in normal atmospheres, but also with little oxygen as a facultative anaerobe, and can infect damaged tissues or immunocompromised individuals. When such colonizations occur in critical body organs such as the lungs, the urinary tract, and kidneys, the results can be fatal. Because it thrives on surfaces, this bacterium is also found on and in medical equipment including catheters, causing cross infections in hospitals and clinics. *P. aeruginosa* is one of the most relevant opportunistic, nosocomial pathogens, and it has been estimated that one in ten hospital-acquired infections are from *Pseudomonas*. *P. aeruginosa* is also the most frequent colonizer of medical devices, such as catheters.

In one embodiment, the invention provides a bacteriophage having a genome comprising or consisting of a nucleic acid having the nucleotide sequence of SEQ ID NO:1. A specific example in accordance with this embodiment is the purified bacteriophage F99/10, which targets a number of strains of *P. aeruginosa*. Open reading frames (orfs) in the F99/10 genome, amino acid sequences encoded by the orfs, and putative functions of the encoded amino acid sequences (i.e., encoded proteins) are provided in FIG. 3.

Figure 3:
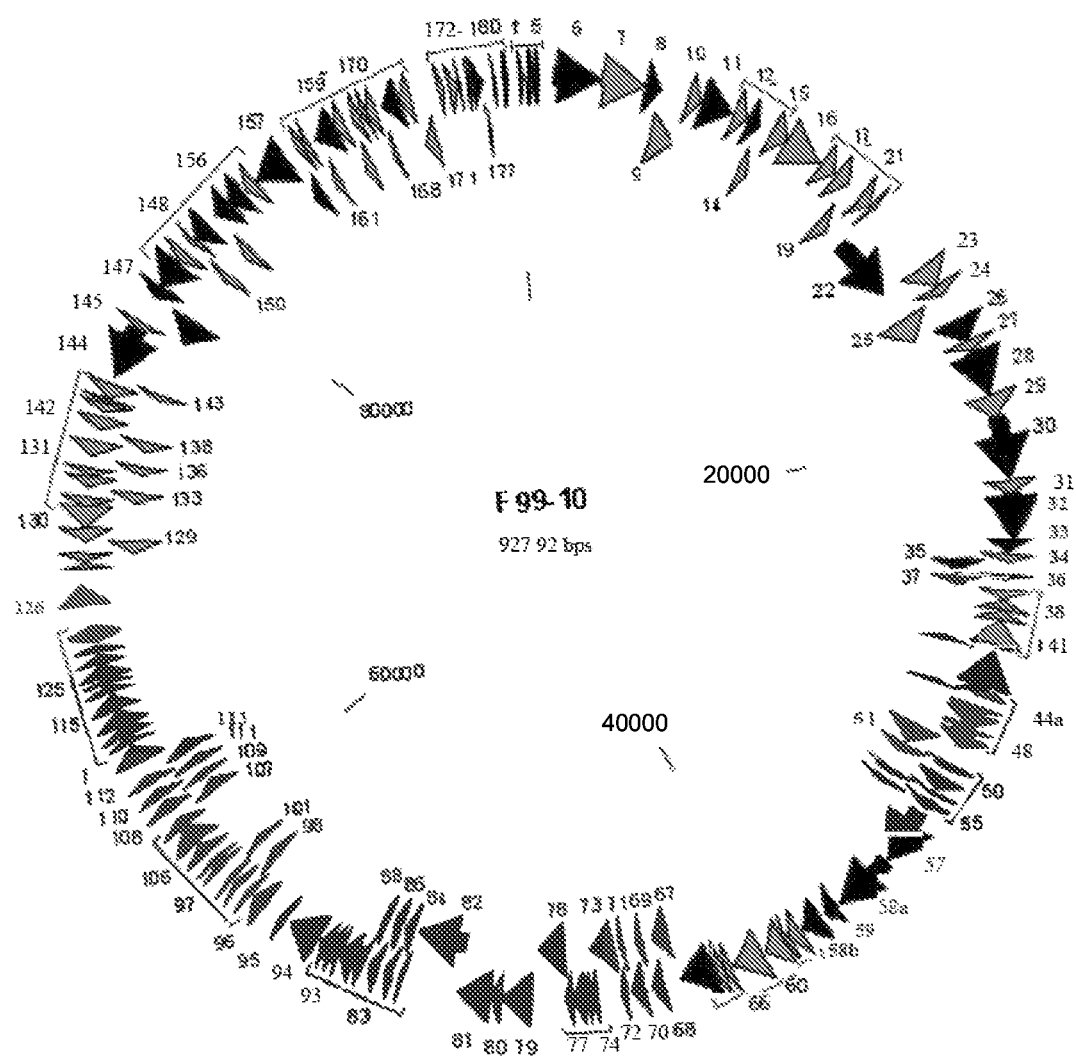
FIG. 3 illustrates the schematic organization of the F99/10 genome with functionally assigned orfs further listed on the bottom.

FIG. 3 illustrates the schematic organization of the F99/10 genome with functionally assigned orfs further listed on the bottom. Further analysis of the genome and gene products is discussed in the Examples, below.

In certain embodiments, the bacteriophage of the invention comprises or consists of a genome having a nucleotide sequence identity of at least 85%, 90%, 95%, 96%, 97%, 98%, or 99% with the nucleic acid sequence of SEQ ID NO: 1, which bacteriophage exhibits at least one biological activity of F99/10, e.g., antibacterial activity such as lytic killing activity. In a particular embodiment, the bacteriophage has at least 97% or greater sequence identity to SEQ ID NO: 1. Alternatively or in addition, the bacteriophage of the invention may have a genome comprising a functional fragment of the nucleic acid of SEQ ID NO: 1.

In another embodiment, the invention provides a bacteriophage having a genome comprising or consisting of the nucleotide sequence of SEQ ID NO:3. A specific example in accordance with this embodiment is the purified bacteriophage F27/12, which also targets a number of *P. aeruginosa* strains. Open reading frames (orf) in the F27/12 genome, amino acid sequences encoded by the orfs, and putative functions of the encoded amino acid sequences (i.e., encoded proteins) are provided in FIG. 4.

Figure 4:
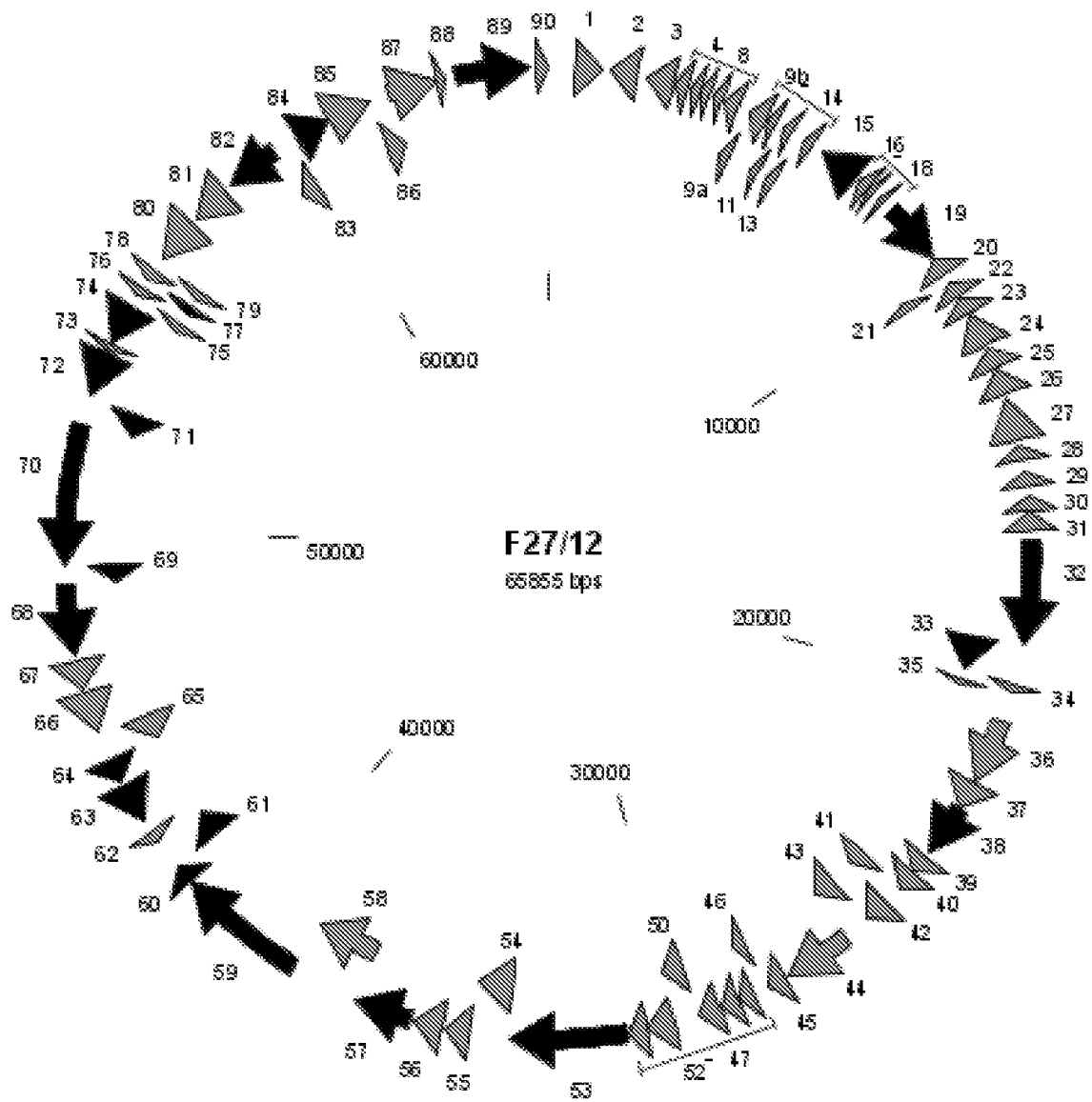
FIG. 4 illustrates the schematic organization of the F27/12 genome with functionally assigned orfs further listed on the right.

FIG. 4 illustrates the schematic organization of the F27/12 genome with functionally assigned orfs further listed on the right. Further analysis of the genome and gene products is discussed in the Examples, below.

In certain embodiments, the bacteriophage of the invention comprises or consists of a genome having a nucleotide sequence identity of at least 85%, 90%, 95%, 96%, 97%, 98%, or 99% with the nucleic acid sequence of SEQ ID NO:3, which bacteriophage exhibits at least one biological activity of F27/12, e.g., antibacterial activity such as lytic killing activity. In a particular embodiment, the bacteriophage has at least over 97% sequence identity to SEQ ID NO:3. Alternatively or in addition, the bacteriophage of the invention may have a genome comprising a functional fragment of the nucleotide sequence of SEQ ID NO:3.

In another embodiment, the invention provides a bacteriophage having a genome comprising or consisting of the nucleic acid sequence of SEQ ID NO:5. A specific example in accordance with this embodiment is the purified bacteriophage F95/13 (a designation used interchangeably with "Psa_F95/13"), which also targets a number of strains of *P. aeruginosa*. Open reading frames (orfs) in the F95/13 genome, amino acid sequences encoded by the orfs, and putative functions of the encoded amino acid sequences (i.e., encoded proteins) are provided in FIG. 5.

Figure 5:
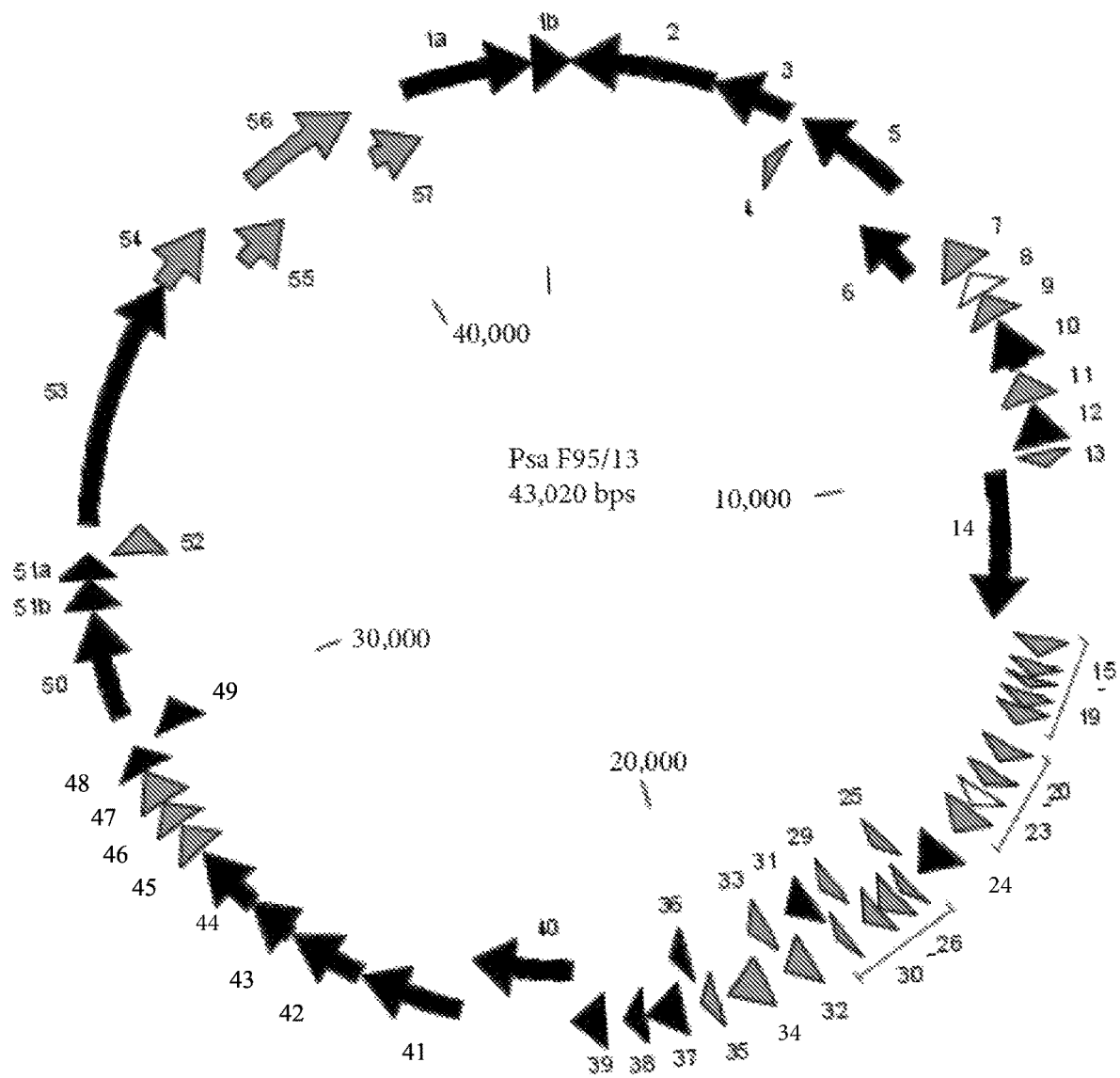
FIG. 5 illustrates the schematic organization of the F95/13 genome with functionally assigned orfs further listed on the right.

FIG. 5 illustrates the schematic organization of the F95/13 genome with functionally assigned orfs further listed on the right. Further analysis of the genome and gene products is discussed in the Examples, below.

In certain embodiments, the bacteriophage of the invention comprises or consists of a genome having a nucleotide sequence identity of at least 85%, 90%, 95%, 96%, 97%, 98%, or 99% with the nucleic acid sequence of SEQ ID NO:5, which bacteriophage exhibits at least one biological activity of F95/13, e.g., antibacterial activity such as lytic killing activity. In a particular embodiment, the bacteriophage has at least over 95% sequence identity to SEQ ID NO:5. Alternatively or in addition, the bacteriophage of the invention may have a genome comprising a functional fragment of the nucleotide sequence of SEQ ID NO:5.

Another aspect of the invention relates to novel *Klebsiella pneumoniae* bacteriophages that target a number of strains of *K. pneumoniae*. *Klebsiella pneumoniae* is a Gram-negative, non-motile, rod-shaped bacterium, found in the normal flora of the mouth, skin, and intestines. As an encapsulated, facultative anaerobe, the bacterium also naturally occurs in the soil. Clinically, it is the most important member of the *Klebsiella* genus of Enterobacteriaceae. *Klebsiella* infections tend to occur in people with a weakened immune system from improper diet, e.g. in alcoholics and diabetics. *Klebsiella* is also an opportunistic pathogen for patients with chronic pulmonary disease, nasal mucosa atrophy, cystic fibrosis, and rhinoscleroma. New antibiotic resistant strains of *K. pneumoniae* are appearing, and it is increasingly found as a nosocomial infection, for example, due to contact with contaminated instruments.

*K. pneumoniae* is indeed one of the most important causative pathogens of respiratory tract infections in humans and alone accounts for 25-43% of the nosocomial pneumonias caused by Gram-negative bacteria (Chibber S et al., 2008, *J Med Microbiol* 57(12):1508-1513). The high incidence of multidrug resistant bacteria has resulted in limited efficacy with current antibiotics, and a high probability of patient colonization by resistant strains. The capsular polysaccharide is an important virulent factor of *Klebsiella* sp. strains, and a limiting factor for phage infection. Literature has described 78 capsular types (Hus C R, et al., 2013, *PLoS*

*One* 8(8):e70092), and phages that infect these species have overcome this "barrier". *K. pneumoniae* virulent strains have been predominantly associated with the K1 and K2 capsular serotypes (Cleg S et al., 2016, *Microbiol Spectr* 4(1); and Lin T Z et al., 2014, *J Infect Dis* 210:1734-1744), such as in pyogenic liver abscess, though the K1 capsular serotype has been associated with community-acquired isolates rather than nosocomial isolates (Tsay R W et al., 2002, *Arch Intern Med* 162(9):1021-1027). Nonetheless, depending on the type of infection, strains can show a diverse range of capsular serotypes and the distribution of *K. pneumoniae* capsular serotypes differs worldwide (Hus C R et al., 2013, *PLoS One* 8(8):e70092).

In one embodiment, the invention provides a bacteriophage having a genome comprising or consisting of the nucleotide sequence of SEQ ID NO:7. A specific example in accordance with this embodiment is the purified bacteriophage F92/15 (a designation used interchangeably with "Kle_F92/15"), which targets a number of strains of *K. pneumoniae*. Open reading frames (orfs) in the F92/15 genome, amino acid sequences encoded by the orfs, and putative functions of the encoded amino acid sequences (i.e., encoded proteins) are provided in FIG. 7.

Figure 7:
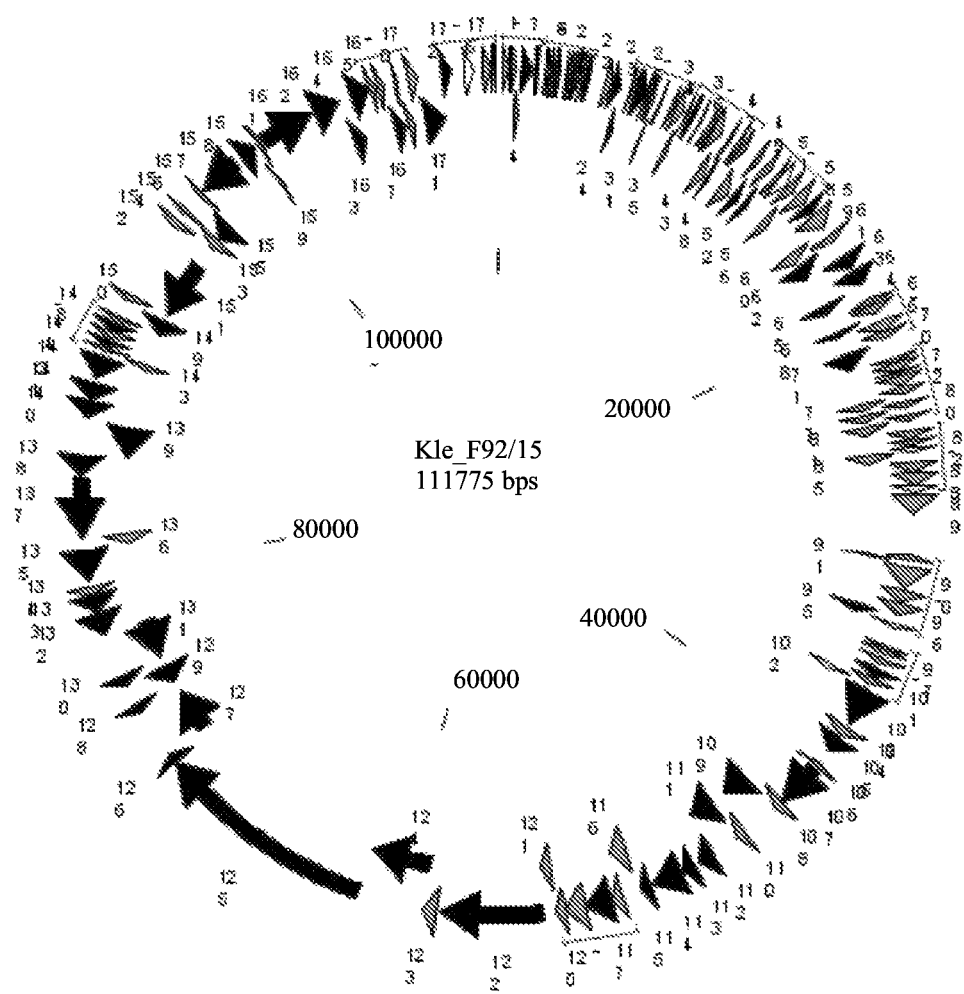
FIG. 7 illustrates the schematic organization of the Kle_F92/15 genome with functionally assigned orfs further listed on the right and on the bottom.

FIG. 7 illustrates the schematic organization of the F92/15 genome with functionally assigned orfs further listed on the right and on the bottom. Further analysis of the genome and gene products is discussed in the Examples, below.

In certain embodiments, the bacteriophage of the invention comprises or consists of a genome having a nucleotide sequence identity of at least 70%, 75%, 80%, 85%, 90%, 95%, 96%, 97%, 98%, or 99% with the nucleotide sequence of SEQ ID NO:7, which bacteriophage exhibits at least one biological activity of F92/15, e.g., antibacterial activity such as lytic killing activity. In a particular embodiment, the bacteriophage has at least over 79% sequence identity to SEQ ID NO:7. Alternatively or in addition, the bacteriophage of the invention may have a genome comprising a functional fragment of the nucleotide sequence of SEQ ID NO:7.

In certain embodiments, the invention provides a bacteriophage having a genome comprising or consisting of the nucleotide sequence of SEQ ID NO:8. A specific example in accordance with this embodiment is the purified bacteriophage F105/15 (a designation used interchangeably with "Kle_F105/15"), which also targets a number of *K. pneumoniae* strains. Open reading frames (orfs) in the F105/15 genome, amino acid sequences encoded by the orfs, and putative functions of the encoded amino acid sequences (i.e., encoded proteins) are provided in FIG. 8.

Figure 8:
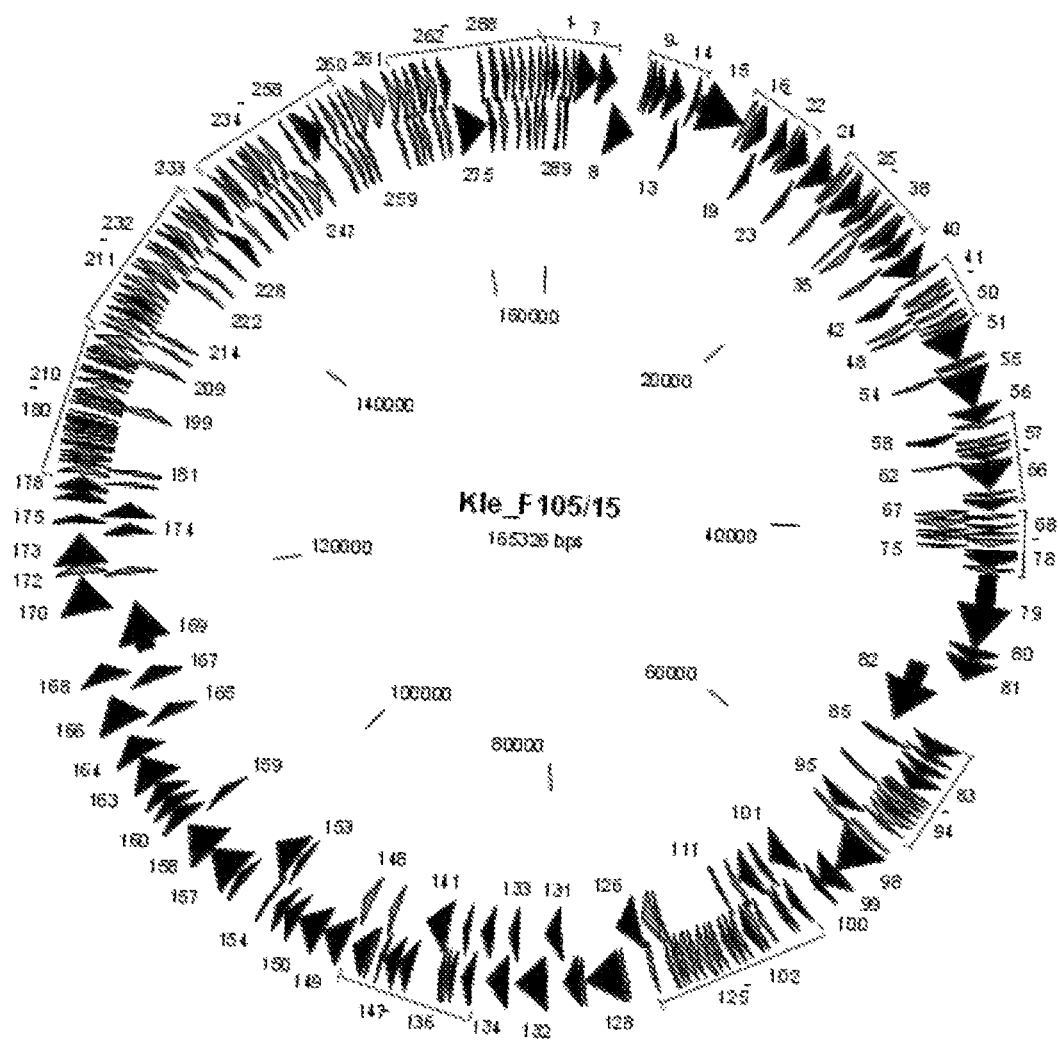
FIG. 8 illustrates the schematic organization of the Kle_F105/15 genome with functionally assigned orfs further listed on the right and on the bottom

FIG. 8 illustrates the schematic organization of the F105/15 genome with functionally assigned orfs further listed on the right and on the bottom. Further analysis of the genome and gene products is discussed in the Examples, below.

In certain embodiments, the bacteriophage of the invention comprises or consists of a genome having a sequence identity of at least 85%, 90%, 95%, 96%, 97%, 98%, or 99% with the nucleic acid sequence of SEQ ID NO:8, which bacteriophage exhibits at least one biological activity F105/15, e.g., antibacterial activity such as lytic killing activity. In a particular embodiment, the bacteriophage has at least over 99% sequence identity to SEQ ID NO:8. Alternatively or in addition, the bacteriophage of the invention may have a genome comprising a functional fragment of the nucleic acid sequence of SEQ ID NO:8.

In certain embodiments, the invention provides a bacteriophage having a genome comprising or consisting of the nucleotide sequence of SEQ ID NO:9. A specific example in accordance with this embodiment is the purified bacteriophage F134/15 (a designation used interchangeably with "Kle_F134/15"), which also targets a number of *K. pneumoniae* strains.

In certain embodiments, the bacteriophage of the invention comprises or consists of a genome having a sequence identity of at least 85%, 90%, 95%, 96%, 97%, 98%, or 99% with the nucleotide sequence of SEQ ID NO:9, which bacteriophage exhibits at least one biological activity of F134/15, e.g., antibacterial activity such as lytic killing activity. In a particular embodiment, the bacteriophage has at least over 98% sequence identity to SEQ ID NO:9. Alternatively or in addition, the bacteriophage of the invention may have a genome comprising a functional fragment of the nucleotide sequence of SEQ ID NO:9.

In certain embodiments, the invention provides a bacteriophage having a genome comprising or consisting of the nucleotide sequence of SEQ ID NO:10. A specific example in accordance with this embodiment is the purified bacteriophage F141/15 (a designation used interchangeably with "Kle_F141/15"), which also targets a number of strains of *K. pneumoniae*.

In certain embodiments, the bacteriophage of the invention comprises or consists of a genome having a sequence identity of at least 85%, 90%, 95%, 96%, 97%, 98%, or 99% with the nucleotide sequence of SEQ ID NO:10, which bacteriophage exhibits at least one biological activity of F141/15, e.g., antibacterial activity such as lytic killing activity. In a particular embodiment, the bacteriophage has at least over 95% sequence identity to SEQ ID NO:10. Alternatively or in addition, the bacteriophage of the invention may have a genome comprising a functional fragment of the nucleotide sequence of SEQ ID NO: 10.

The invention also provides for isolated bacteria infected with one or more of the bacteriophages of the invention. In certain embodiments, the invention provides purified *P. aeruginosa* infected with one or more bacteriophages, where the phage comprises or consists of a nucleic acid having a nucleotide sequence selected from any one of SEQ ID NOs: 1, 2, 3, 4, 5. In other embodiments, the invention provides purified *K. pneumonia* infected with one or more bacteriophages, where the phage comprises or consists of a nucleic acid having a nucleotide sequence selected from any one of SEQ ID NOs:7-10.

Phage Proteins and Variants Thereof

The invention also provides for polypeptides isolated from a bacteriophage of the invention. The isolated polypeptides may be full length bacteriophage proteins or may be fragments or variants of the bacteriophage proteins provided that the fragment or variant exhibits at least one biological activity associated with the bacteriophage or polypeptide from which it is derived. In certain embodiments, the polypeptides of the invention are isolated from bacteriophage F99/10, F27/12, or F95/13, each of which typically infects *P. aeruginosa*.

In certain embodiments, the polypeptides of the invention are isolated from bacteriophage F92/15, F105/15, F134/15, or F141/15, each of which typically infects *K. pneumoniae*.

In certain embodiments, the polypeptides of the present invention are recombinantly fused or chemically conjugated (including both covalent and non-covalent conjugations) to therapeutic agents, e.g., heterologous polypeptides or small molecules, to generate fusion proteins or chimeric polypeptides. The fusion does not necessarily need to be direct, but may occur through linker sequences or through chemical conjugation. Non-limiting examples of therapeutic agents to which the polypeptides of the invention may be conjugated are peptide or non-peptide cytotoxins (including antimicrobials and/or antibiotics), tracer/marker molecules (e.g., radionuclides and fluorphores) and other antibiotic or antibacterial compounds known in the art.

Cocktail Compositions

A particular aspect of the invention relates to cocktail compositions of different bacteriophages. The "cocktail" may comprise at least two different purified bacteriophage, for example, two, three, four, five, six, seven, eight, nine, ten, or more different purified bacteriophages, or variants thereof. The cocktail may be used alone or in further combination with other therapies, e.g., antibiotic agents and/or antifungal agents.

Phage cocktails provide advantages over the use of phages individually, e.g., to increase the lytic activity against a particular species or strain of bacteria and/or to decrease the possibility of emergence of bacteria resistant to an individual bacteriophage. Different bacteriophage also can be mixed as cocktails to broaden their properties, preferably resulting in a collectively greater antibacterial spectrum of activity. However, few phage cocktails exist with antimicrobial activity against different bacteria, probably because of the difficulty in combining different specificities of bacteriophage strains, while maintaining infecting ability and/or lytic activity of the individual bacteriophage in the presence of distinct strains.

In some embodiments, the invention provides cocktail compositions comprising at least two different purified bacteriophages, with antibacterial activity against the same or different bacterial species or strains. In some particular embodiments, the instant invention provides a cocktail composition comprising at least two different purified bacteriophages, each comprising a nucleic acid having a nucleotide sequence selected from SEQ ID NO:1 (F99/10), SEQ ID NO:3 (F27/12), SEQ ID NO:5 (F95/13), SEQ ID NO:6 (F391/08), SEQ ID NO:7 (F92/15), SEQ ID NO:8 (F105/15), SEQ ID NO:9 (F134/15), and SEQ ID NO:10 (F141/15), or a variant thereof having antibacterial activity against *Pseudomonas aeruginosa* and/or *Klebsiella pneumoniae*. For example, the cocktail may comprise a phage variant that has a genome comprising a functional fragment of the nucleic acid sequence of SEQ ID NO: 1, SEQ ID NO:3, SEQ ID NO:5, SEQ ID NO:6, SEQ ID NO:7, SEQ ID NO:8, SEQ ID NO:9, SEQ ID NO:10, to give a variant bacteriophage that exhibits at least one biological activity, e.g., antibacterial activity (e.g., lytic killing activity), of bacteriophage F99/10, F27/12, F95/13, F391/08, F92/15, F105/15, F134/15, and F141/15, respectively.

In some particular embodiments, the instant invention provides a cocktail composition comprising at least two different purified bacteriophages, each comprising a nucleic acid having a nucleotide sequence which has at least 97% sequence identity to SEQ ID NO:1 (F99/10), at least 97% sequence identity to SEQ ID NO:3 (F27/12), at least 97% sequence identity to SEQ ID NO:5 (F95/13), at least 90% sequence identity to SEQ ID NO:6 (F391/08), at least 90% sequence identity to SEQ ID NO:7 (F92/15), at least 99% sequence identity to SEQ ID NO:8 (F105/15), at least 98% sequence identity to SEQ ID NO:9 (F134/15), or at least 95% sequence identity to SEQ ID NO:10 (F141/15), and having antibacterial activity against *Pseudomonas aeruginosa* and/or *Klebsiella pneumoniae*. For example, the pharmaceutical composition may comprise at least two different purified bacteriophages each comprising a nucleic acid having the nucleotide sequence selected from the group consisting of SEQ ID NO:1 (F99/10), SEQ ID NO:3 (F27/12), SEQ ID NO:5 (F95/13), SEQ ID NO:6 (F391/08), SEQ ID NO:7 (F92/15), SEQ ID NO:8 (F105/15), SEQ ID NO:9 (F134/15), and SEQ ID NO:10 (F141/15).

In some preferred embodiments, the combination does not impair or reduce (or does not substantially or significantly impair or reduce) infection ability or host range and/or lytic activity of the individual bacteriophage in the presence of distinct bacteriophage strains. In some particularly preferred embodiments, the efficacy of at least one phage in the cocktail combination is enhanced or improved due to the presence of at least one other phage in the cocktail combination, producing a synergistic effect.

In some embodiments, the cocktail composition comprises at least one phage showing antibacterial activity against *P. aeruginosa*. In some particular embodiments, the invention provides a cocktail composition comprising at least two different purified bacteriophages, each comprising a nucleic acid having a nucleotide sequence selected from SEQ ID NO:1 (F99/10), SEQ ID NO:3 (F27/12), or SEQ ID NO:5 (F95/13), or a variant thereof having antibacterial activity against *P. aeruginosa*. In some particular embodiments, the invention provides a cocktail composition comprising at least two different purified bacteriophages, each comprising a nucleic acid having a nucleotide sequence which has at least 97% sequence identity to SEQ ID NO:1 (F99/10), at least 97% sequence identity to SEQ ID NO:3 (F27/12), or at least 97% sequence identity to SEQ ID NO:5 (F95/13), and has antibacterial activity against *P. aeruginosa*.

In particularly preferred embodiments, the composition comprises the three bacteriophages comprising a nucleic acid having a nucleotide sequence with at least 97% sequence identity to SEQ ID NO:1 (F99/10), at least 97% sequence identity to SEQ ID NO:3 (F27/12), and at least 97% sequence identity to SEQ ID NO: 5 (F95/13) and having antibacterial activity against *Pseudomonas aeruginosa*. For example, the composition may comprise the three bacteriophages comprising the nucleic acids of SEQ ID NO:1 (F99/10), SEQ ID NO:3 (F27/12) and SEQ ID NO: 5 (F95/13).

In some embodiments, the cocktail composition comprises at least one phage showing antibacterial activity against *K. pneumoniae*. In some particular embodiments, the invention provides a cocktail composition comprising at least two different purified bacteriophages, each comprising a nucleic acid having a nucleotide sequence selected from SEQ ID NO:6 (F391/08), SEQ ID NO:7 (F92/15), SEQ ID NO:8 (F105/15), SEQ ID NO:9 (F134/15), and SEQ ID NO:10 (F141/15), or a variant thereof having antibacterial activity against *K. pneumoniae*. For example, in some preferred embodiments, a variant of bacteriophage F391/08 comprises or consists of a genome having a sequence identity of at least 60%, 65%, 70%, 75%, 80%, 85%, 90%, 93%, 94%, 95%, 96%, 97%, 98%, or 99% with the nucleic acid sequence of SEQ ID NO:6 and maintains antibacterial activity (e.g., lytic killing activity) against one or more of strains of *Klebsiella* species, more preferably including *K. pneumoniae*.

In some particular embodiments, the instant invention provides a cocktail composition comprising at least two different purified bacteriophages each comprising a nucleic acid having a nucleotide sequence with at least 90% sequence identity to SEQ ID NO:6 (F391/08), at least 90% sequence identity to SEQ ID NO:7 (F92/15), at least 99% sequence identity to SEQ ID NO:8 (F105/15), at least 98% sequence identity to SEQ ID NO:9 (F134/15), or at least 95% sequence identity to SEQ ID NO:10 (F141/15), and having antibacterial activity against *Klebsiella pneumoniae*.

Particularly preferred embodiments combine antibacterial activities against both bacterial species. For example, in some embodiments, the instant invention provides a cocktail composition comprising at least two different purified bacteriophages, the first phage comprising a nucleic acid having a nucleotide sequence with at least 97% sequence identity to SEQ ID NO:1 (F99/10), at least 97% sequence identity to SEQ ID NO:3 (F27/12), or at least 97% sequence identity to SEQ ID NO:5 (F95/13) and having antibacterial activity against *P. aeruginosa*; and the second phage comprising a nucleic acid having a nucleotide sequence with at least 90% sequence identity to SEQ ID NO:6 (F391/08), at least 90% sequence identity to SEQ ID NO:7 (F92/15), at least 99% sequence identity to SEQ ID NO:8 (F105/15), at least 98% sequence identity to SEQ ID NO:9 (F134/15), or at least 95% sequence identity to SEQ ID NO: 10 (F141/15), and having antibacterial activity against *K. pneumoniae*. For example, the pharmaceutical composition may comprise at least two different purified bacteriophages, the first phage comprising the nucleic acid having the nucleotide sequence selected from the group consisting of SEQ ID NO:1 (F99/10), SEQ ID NO:3 (F27/12), and SEQ ID NO:5 (F95/13); and the second phage comprising the nucleic acid having the nucleotide sequence selected from the group consisting of SEQ ID NO:6 (F391/08), SEQ ID NO:7 (F92/15), SEQ ID NO:8 (F105/15), SEQ ID NO:9 (F134/15), and SEQ ID NO:10 (F141/15).

In some embodiments, the invention provides a cocktail composition further in combination with at least one additional phage other than F99/10, F27/12, F95/13, F391/08, F92/15, F105/15, F134/15, or F141/15. In some preferred embodiments, the additional phage is selected from the group consisting of bacteriophage F168/08 having antibiotic activity against one or more strains of *E. faecalis* and/or *E. faecium* (as disclosed in WO 2010/090542), bacteriophage F170/08 having antibiotic activity against one or more strains of *E. faecalis* and/or *E. faecium* (as disclosed in WO 2010/090542), bacteriophage F770/05 having antibacterial activity against one or more strains of *P. aeruginosa* (as disclosed in WO 2010/090542), bacteriophage F197/08 having antibacterial activity against one or more strains of *Staphylococcus aureus* (as disclosed in WO 2010/090542), bacteriophage F86/06 having antibacterial activity against one or more strains of *Staphylococcus aureus* (as disclosed in WO 2010/090542), bacteriophage F87s/06 having antibacterial activity against one or more strains of *Staphylococcus aureus* (as disclosed in WO 2010/090542), bacteriophage F91a/06 having antibacterial activity against one or more strains of *Staphylococcus aureus* (as disclosed in WO 2010/090542), bacteriophage F1245/05 having antibacterial activity against one or more strains of *Acinetobacter baumanni* (as disclosed in WO 2010/090542), bacteriophage strain F394/08 having antibacterial activity against one or more strains of *Acinetobacter baumanni* (as disclosed in WO 2012/036580), bacteriophage F488/08 having antibacterial activity against one or more strains of *Escherichia coli* (as disclosed in WO 2012/036580), bacteriophage F510/08 having antibacterial activity against one or more strains of *P. aeruginosa* (as disclosed in WO 2012/036580), bacteriophage F44/10 having antibacterial activity against one or more strains of *Staphylococcus aureus* (as disclosed in WO 2012/036580), bacteriophage F387/08 having antibacterial activity against one or more strains of *Klebsiella pneumoniae* (as disclosed in WO 2012/036580), and bacteriophage F125/10 having antibacterial activity against one or more strains of *Staphylococcus aureus* (as disclosed in WO 2012/036580) (the contents of each are hereby incorporated by reference in their entireties).

The invention also provides for isolated bacteria (including two or more different strains or species of bacteria) infected with one or more of the bacteriophage of the invention and, in particular, a cocktail combination in accordance with the present invention. In certain embodiments, the invention provides an isolated *P. aeruginosa* strain infected with two or more different phages, each comprising or consisting of a nucleic acid having the nucleotide sequence of SEQ ID NO: 1, SEQ ID NO:3, or SEQ ID NO:5, or a variant thereof, such as a phage comprising or consisting of a nucleic acid having a nucleotide sequence with at least 97% sequence identity to SEQ ID NO:1 (F99/10), at least 97% sequence identity to SEQ ID NO:3 (F27/12), or at least 97% sequence identity to SEQ ID NO:5 (F95/13) and having antibacterial activity against *Pseudomonas aeruginosa*. The bacterial strain used may or may not be the natural host for the phage. In particular embodiments, the *P. aeruginosa* bacteria comprise *P. aeruginosa* 114/12 strain, *P. aeruginosa* 460/06 strain, *P. aeruginosa* 433/07 strain, *P. aeruginosa* 66/09 strain and/or *P. aeruginosa* 1992/05 strain.

In certain embodiments, the invention provides an isolated *K. pneumoniae* strain infected with two or more bacteriophage, each comprising or consisting of a nucleic acid having the nucleotide sequence of SEQ ID NO:6, SEQ ID NO:7, SEQ ID NO:8, SEQ ID NO:9, or SEQ ID NO: 10, or a variant thereof, such as a bacteriophage comprising or consisting of a nucleic acid having a nucleotide sequence with at least 90% sequence identity to SEQ ID NO:6 (F391/08), at least 90% sequence identity to SEQ ID NO:7 (F92/15), at least 99% sequence identity to SEQ ID NO:8 (F105/15), at least 98% sequence identity to SEQ ID NO:9 (F134/15), or at least 95% sequence identity to SEQ ID NO:10 (F141/15), and having antibacterial activity against *K. pneumoniae*. The bacterial strain used may or may not be the natural host for the phage.

The bacterial strains and phages were deposited with the NCIMB (NCIMB Ltd, Ferguson Building, Craibstone Estate, Bucksburn, Aberdeen, UK) on 1 Dec. 2017 under the following NCIMB accession numbers:

NCIMB 42914 *Pseudomonas aeruginosa* 1992/05-B4
NCIMB 42915 *Pseudomonas aeruginosa* phage F6-F99/10
NCIMB 42916 *Pseudomonas aeruginosa* phage F7-F27/12
NCIMB 42917 *Pseudomonas aeruginosa* phage F8-F95/13
NCIMB 42918 *Klebsiella pneumoniae* F9-F391/08
NCIMB 42919 *Klebsiella pneumoniae* F10-F92/15
NCIMB 42920 *Klebsiella pneumoniae* F11-F105/15
NCIMB 42913 *Klebsiella pneumoniae* 121/15-B5

The bacteriophage of the invention and/or for use in cocktail compositions of the invention, can be obtained by any methods known in the art and/or disclosed herein. In some embodiments, the invention provides for methods of production and purification of a bacteriophage comprising or consisting of the nucleic acid sequence of SEQ ID NO: 1, SEQ ID NO:3, SEQ ID NO:5, SEQ ID NO:7, SEQ ID NO:8, SEQ ID NO:9, or SEQ ID NO:10. For example, the genomic sequences may be produced by whole-genome de novo synthesis (see, e.g., Mueller et al., 2009, Chemistry & Biology 16(3): 337-347 (reviewing landmark developments in this field, surveying commercial availability of relevant technology from the mid 90's to the late 2000's, and outlining developments in methods for synthesizing oligonucleotides and assembling long synthetic DNA)).

Further, bacteriophage may be isolated from a bacterial sample using any method described herein or known in the art (see, e.g., Carlson, "Working with bacteriophages: common techniques and methodological approaches," In, Kutter and Sulakvelidze (Eds) Bacteriophages: Biology and Applications, 5th ed. CRC Press (2005), incorporated herein by reference in its entirety). Specific bacterial strains that may be used include, e.g. *Pseudomonas aeruginosa* 114/12, 460/06, 433/07, 66/09, and 1992/05 strains (e.g., for isolating phage F99/10, F110/10, F27/12, F83/13, and/or F95/13); or *Klebsiella pneumoniae* 223/14, 397/07, 1633/05, 241/14 strains (e.g., for isolating phage F391/08, F92/15, F105/15, F134/15, and/or F141/15). Bacteriophage also may be isolated from any other bacterial strain susceptible to infection by one or more of the bacteriophage, and in which the bacteriophage replicate.

The skilled artisan also may use one or more methods to propagate or amplify a bacteriophage having a genome comprising or consisting of a nucleic acid sequence of SEQ ID NO:1, SEQ ID NO:3, SEQ ID NO:5, SEQ ID NO:6, SEQ ID NO:7, SEQ ID NO:8, SEQ ID NO:9, or SEQ ID NO: 10, as well of variants thereof, so as to obtain greater amounts of a given phage. In some embodiments, a method of producing and/or isolating additional phages having a genome that comprises or consists of a nucleic acid having a nucleotide sequence of SEQ ID NO: 1, SEQ ID NO:3, or SEQ ID NO:5, or a variant thereof, may comprise (i) obtaining a culture of *P. aeruginosa*; (ii) infecting it with the bacteriophage having a genome comprising or consisting of the nucleotide sequence of SEQ ID NO: 1, SEQ ID NO:3, or SEQ ID NO:5, or a variant thereof; (iii) culturing until significant lysis of the culture is observed; and (iv) isolating from the culture the bacteriophage. The host cell used may be any bacterial strain, for example, any *P. aeruginosa* strain susceptible to infection by the phage that can be used to replicate the phage. In some embodiments, the host cell used is *P. aeruginosa* 114/12 strain, *P. aeruginosa* 460/06 strain, *P. aeruginosa* 433/07 strain, *P. aeruginosa* 66/09 and *P. aeruginosa* 1992/05 strain. In some particular examples, *P. aeruginosa* 114/12 strain is used to amplify phage F27/12 (SEQ ID NO:3); *P. aeruginosa* 460/06 strain is used to amplify F99/10 (SEQ ID NO: 1), *P. aeruginosa* 433/07 strain is used to amplify Psa_F83/13, as well as any of F99/10, or F27/12; *P. aeruginosa* 66/09 is used to amplify phage Psa_F95/13, and *P. aeruginosa* 1992/05 is used to amplify F99/10 (SEQ ID NO:1) or F27/12 (SEQ ID NO: 3) or F95/13 (SEQ ID NO: 5).

The skilled artisan also may use one or more methods to propagate or amplify a bacteriophage having a genome comprising or consisting of the nucleic acid sequence of SEQ ID NO:6, SEQ ID NO:7, SEQ ID NO:8, SEQ ID NO:9, SEQ ID NO:10, as well of variants thereof, so as to obtain greater amounts of a given phage. In some embodiments, a method of producing and/or isolating additional phage having a genome that comprises or consists of the nucleic acid sequence of SEQ ID NO:6, SEQ ID NO:7, SEQ ID NO:8, SEQ ID NO:9, or SEQ ID NO: 10, or a variant thereof, may comprise (i) obtaining a culture of *K. pneumoniae*, (ii) infecting it with the bacteriophage having a genome comprising or consisting of a nucleotide sequence of SEQ ID NO:6, SEQ ID NO:7, SEQ ID NO:8, SEQ ID NO:9, or SEQ ID NO:10, or a variant thereof; (iii) culturing until significant lysis of the culture is observed; and (iv) isolating from the culture the bacteriophage. The host cell used may be any bacterial strain, for example, any *K. pneumoniae* strain susceptible to infection by the phage that can be used to replicate the phage. In some embodiments, the host cell used may be, for example, *K. pneumoniae* 573/07 strain, *K. pneumoniae* 223/14 strain, *K. pneumoniae* 397/07 strain, *K. pneumoniae* 1633/05 strain, and/or *K. pneumoniae* 241/14 strain. In some particular examples, phage F391/08 is amplified in *K. pneumoniae* 573/07 strain; phage Kle_F92/15 is amplified in *K. pneumoniae* 223/14 strain; phage Kle_F105/15 is amplified in *K. pneumoniae* 1633/05 strain; Kle_F134/15 is amplified in *K. pneumoniae* 397/07 strain; and Kle_F141/15 is amplified in *K. pneumoniae* 241/14 strain.

Pharmaceutical Compositions

The purified bacteriophages and phage products of the present invention, including phage polypeptides, fragments or variants thereof, and phage cocktail combinations, may be administered alone or incorporated into a pharmaceutical composition for the use in treatment or prophylaxis of bacterial infections, e.g., infections caused by bacteria including, but not limited to, *P. aeruginosa* and *K. pneumoniae*. The bacteriophage(s) or phage product(s) may be combined with a pharmaceutically acceptable carrier, excipient, or stabilizer. Examples of pharmaceutically acceptable carriers, excipients and stabilizers include, but are not limited to, buffers such as phosphate, citrate, and other organic acids; antioxidants including ascorbic acid; low molecular weight polypeptides; proteins, such as serum albumin and gelatin; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLUONICS™. The pharmaceutical compositions of the present invention (e.g., antibacterial compositions) can also include a lubricant, a wetting agent, an emulsifier, a suspending agent, and a preservative, e.g., in addition to the above ingredients.

In some embodiments, the pharmaceutical compositions are formulated for administration as an aerosol. Formulations for aerosol delivery may be in the form of a dry powder, fine particles, nanoparticles, solutions, lyophilized preparations, liposomal preparations, and the like. Liposomal formulations can protect the bacteriophage from the harsh condition of the sputum, as well as improving penetration into biofilms and/or allowing more sustained release of the agent within airways. Formulations for aerosol delivery typically comprise sterile water and little or no preservatives, to reduce side effects such as bronchial irritation and bronchospasm. Formulations for aerosol delivery preferably have an osmolality the same as, or substantially the same as, the osmolality of airway surface liquid.

The phages and/or phage products of the present invention may be combined with one or more other therapeutic and/or prophylactic agents useful for the treatment of bacterial infection as described herein and/or known in the art, e.g. one or more other phages. For example, a pharmaceutical composition of the invention may comprise two or more purified bacteriophages of the invention (with antibacterial activity against the same or different bacterial species or strains), the combination of a bacteriophage and a polypeptide of the invention, or the combination of a bacteriophage and/or polypeptide of the invention and a bacteriophage and/or polypeptide known in the art. In specific embodiments, the therapeutic components of a combination target two or more species or strains of bacteria or exhibit differing enzymatic activity. For example, lysins in general exhibit one of amidase, endopeptidase, muramidase, or glucosamidase activity. Accordingly, the combination of phages with lysins exhibiting different activities may provide synergistic enhancement to the therapeutic activity of the pharmaceutical composition of the invention.

The pharmaceutical compositions of the present invention also may be combined with one or more non-phage therapeutic and/or prophylactic agents, useful for the treatment and/or prevention of bacterial infections, as described herein and/or known in the art (e.g. one or more traditional antibiotic agents). Other therapeutic and/or prophylactic agents that may be used in combination with the phage(s) or phage product(s) of the invention include, but are not limited to, antibiotic agents, anti-inflammatory agents, antiviral agents, antifungal agents, or local anesthetic agents. In some preferred embodiments, the pharmaceutical composition is formulated for treatment and/or prevention of pulmonary infections and comprises one or more additional therapeutic and/or prophylactic agents selected from antibiotic agents, antifungal agents, and local anesthetic agents. In some embodiments, the pharmaceutical composition comprises a phage cocktail combination of the invention, which is administered in the absence of a standard or traditional antibiotic agent.

Standard or traditional antibiotic agents include, but are not limited to, amikacin, gentamicin, kanamycin, neomycin, netilmicin, paromomycin, rhodostreptomycin, streptomycin, tobramycin, apramycin, rifamycin, naphthomycin, mupirocin, geldanamycin, ansamitocin, carbacephems, imipenem, meropenem, ertapenem, faropenem, doripenem, panipenem/betamipron, biapenem, PZ-601, cephalosporins, cefacetrile, cefadroxil, cefalexin, cefaloglycin, cefalonium, cefaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefmetazole, cefotetan, cefoxitin, cefcapene, cefdaloxime, cefdinir, cefditoren, cefetamet, cefixime, cefmenoxime, cefteram, ceftibuten, ceftiofur, ceftiolene, ceftizoxime, ceftriaxone, cefoperazone, ceftazidime latamoxef, cefclidine, cefepime, cefluprenam, cefoselis, cefozopran, cefpirome, cefquinome, flomoxef, ceftobiprole, azithromycin, clarithromycin, dirithromycin, erythromycin, roxithromycin, aztreonam, pencillin and penicillin derivatives, actinomycin, bacitracin, colistin, polymyxin B, cinoxacin, flumequine, nalidixic acid, oxolinic acid, piromidic acid, pipemidic acid, rosoxacin, ciprofloxacin, enoxacin, fleroxacin, lomefloxacin, nadifloxacin, norfloxacin, ofloxacin, pefloxacin, rufloxacin, balofloxacin, gatifloxacin, grepafloxacin, levofloxacin, moxifloxacin, pazufloxacin, sparfloxacin, temafloxacin, tosufloxacin, clinafloxacin, garenoxacin, gemifloxacin, stifloxacin, trovalfloxacin, prulifloxacin, acetazolamide, benzolamide, bumetanide, celecoxib, chlorthalidone, clopamide, dichlorphenamide, dorzolamide, ethoxyzolamide, furosemide, hydrochlorothiazide, indapamide, mafendide, mefruside, metolazone, probenecid, sulfacetamide, sulfadimethoxine, sulfadoxine, sulfanilamides, sulfamethoxazole, sulfasalazine, sultiame, sumatriptan, xipamide, tetracycline, chlortetracycline, oxytetracycline, doxycycline, lymecycline, meclocycline, methacycline, minocycline, rolitetracycline, methicillin, nafcillin, oxacilin, cloxacillin, vancomycin, teicoplanin, clindamycin, co-trimoxazole, flucloxacillin, dicloxacillin, ampicillin, amoxicillin and any combination thereof.

In some embodiments, the pharmaceutical composition of the invention comprises an antibiotic agent having antibacterial activity against *P. aeruginosa* and/or *K. pneumoniae*. In some other embodiments, the pharmaceutical composition of the invention comprises an antibiotic agent having antibacterial activity against bacteria other than *P. aeruginosa* and/or *K. pneumoniae*. In preferred embodiments, the antibiotic agent is used in an amount effective to additively or synergistically enhance the therapeutic and/or prophylactic effect of a phage, phage product, or phage cocktail of the present invention for a given infection.

Standard antifungal agents include amphotericin B such as liposomal amphotericin B and non-liposomal amphotericin B.

In some preferred embodiments, the pharmaceutical composition of the invention is formulated for administration as an aerosol and further comprises one or more antibiotics also for aerosol delivery. Antibiotics for aerosol delivery include, e.g., inhaled aminoglycosides, such as tobramycin like tobramycin solution or tobramycin dry powder, gentamicin, amikacin, inhaled polymyxins, such as colistin solution or colistin dry powder and colistimethate sodium; and inhaled monobactams, such as aztreonam solution or nebulized aztreonam lysine; as well as aerosolized levofloxacin, ceftazidime, fosfomycin, gentamicin, vancomycin, amphotericin, capreomycin, fifampin, isoniazid, and ciproflaxin (Quon B S et al., 2014, Annals ATS 11(3):425-434.) In some embodiments, the aerosolized pharmaceutical composition of the invention further comprises one or more antifungal agents also for aerosol delivery, such as liposomal amphotericin B.

In some embodiments, the pharmaceutical composition of the invention is formulated for use in treating and/or preventing bacterial infections caused by *Pseudomonas* species, such as *P. aeruginosa*. In some such embodiments, the pharmaceutical composition comprises a cocktail composition comprising one or more bacteriophage having a genome comprising or consisting of a nucleic acid having the nucleotide sequence of SEQ ID NO:1, SEQ ID NO:3, or SEQ ID NO:5, or a variant thereof, such as a bacteriophage comprising or consisting of a nucleic acid having a nucleotide sequence with at least 97% sequence identity to SEQ ID NO:1 (F99/10), at least 97% sequence identity to SEQ ID NO:3 (F27/12), or at least 97% sequence identity to SEQ ID NO:5 (F95/13) and having antibacterial activity against *P. aeruginosa*. In some embodiments, the pharmaceutical composition may further comprise an additional agent, e.g., an antibiotic agent having antibacterial activity against *P. aeruginosa*; and/or an antibiotic agent having antibacterial activity against bacteria other than *P. aeruginosa*.

In some embodiments, the pharmaceutical composition of the invention is formulated for use in treating and/or preventing bacterial infections caused by *Klebsiella* species, such as *K. pneumonae*. In some such embodiments, the pharmaceutical composition comprises a cocktail composition comprising one or more bacteriophage having a genome comprising or consisting of a nucleic acid having a nucleotide sequence of SEQ ID NO:6, SEQ ID NO:7, SEQ ID NO:8, SEQ ID NO:9, or SEQ ID NO: 10, or a variant thereof, such as a bacteriophage comprising or consisting of a nucleic acid having a nucleotide sequence with at least 90% sequence identity to SEQ ID NO:6 (F391/08), at least 90% sequence identity to SEQ ID NO:7 (F92/15), at least 99% sequence identity to SEQ ID NO:8 (F105/15), at least 98% sequence identity to SEQ ID NO:9 (F134/15), or at least 95% sequence identity to SEQ ID NO:10 (F141/15), and having antibacterial activity against *K. pneumoniae*. In some embodiments, the pharmaceutical composition may further comprise an additional agent, e.g., an antibiotic agent having antibacterial activity against *K. pneumoniae*; and/or an antibiotic agent having antibacterial activity against bacteria other than *K. pneumoniae*.

Pharmaceutical compositions comprising a phage, phage product, or phage cocktail of the present invention can be formulated in a unit dose or multi-dose formulation. Preferred formulations are formulations that can be delivered as an aerosol, as discussed above. Other suitable formulations include a suspension, emulsion, lotion, solution, cream, ointment, or dusting powder, or in a skin patch.

In addition or alternatively, the pharmaceutical compositions of the invention can be administered in the form of a suppository or pessary, orally (e.g., as a tablet, which may contain excipients such as starch or lactose, as a capsule, ovule, elixir, solution, or suspension, each optionally containing flavoring, coloring agents, and/or excipients), or they can be injected parenterally (e.g., intravenously, intramuscularly, or subcutaneously). For parenteral administration, the compositions may be used in the form of a sterile aqueous solution which may contain other substances, for example enough salts or monosaccharides to make the solution isotonic with blood. For buccal or sublingual administration, the compositions may be administered in the form of tablets or lozenges, which can be formulated in a conventional manner. Topical formulations generally include a sterile buffer, such as a sterile PBS, water, or saline buffer, or a sterile SM buffer.

Modes of administration described herein and/or known in the art may be used to deliver desired dosages of the phages, phage products, and/or phage cocktails of the invention and in accordance with suitable dosage regimens. Dosages and dosage regimens may vary depending on the particular formulation, route of administration, condition being treated, and other factors. Animal experiments can provide reliable guidance for the determination of effective doses in human therapy, e.g., as within the skill of the ordinary physician. Interspecies scaling of effective doses can be performed by one of ordinary skill in the art following the principles described, e.g., by Mordenti, J. et al. "The use of interspecies scaling in toxicokinetics" in Toxicokinetics and New Drug Development, Yacobi et al., Eds., Pergamon Press, New York 1989, pp 42-96. For example, a murine model of acute pulmonary infection can be used to evaluate efficacy of pharmaceutical compositions of the invention, as detailed in the Examples below.

The pharmaceutical compositions of the invention can be administered according to a dosage regimen. In some embodiments, the dosage regime involves administration of a cocktail composition of the invention every 6 hours (the present inventors previously disclosed a multiple dosing regimen for a topical phage cocktail on diabetic cutaneous wounds (Mendes J J, et al., 2013, Wound Repair Regen 21:595-603)). In preferred embodiments, initial administration is followed by a second or "booster" dose, involving re-administration of the pharmaceutical composition. For example, the booster may follow an initial dose after about 1 hour, 2 hours, 3 hours, 4, hours, 5, hours, 6 hours, 7 hours, 8 hours, 10 hours, 12 hours, 1 day, or 2 days. In preferred embodiments, e.g., in treating respiratory or pulmonary infections, including but not limited to hospital-acquired bacterial pneumonia (HABP), a booster dose is use about 4, about 5, or about 6 hours after the initial dose.

Therapeutic Use

Another aspect of the instant invention relates to the use of phages, phage products, or phage cocktails of the invention in pharmaceutical compositions for preventing and/or treating bacterial infections. Phage present great potential for treating bacterial infections, due to their specificity and effectiveness in lysing pathogenic bacteria, including those associated with multidrug resistance (Larche J, et al., 2012, Antimicrob Agents Chemother 56(12):6175-6180), their potential efficiency against bacteria in biofilms (Phee A et al., 2013, J Endod 39(3):364-369); their lack of pathogenicity towards human and animal cells (Abedon S T et al., 2011, Bacteriophage 1(2):66-85), and their activity in microaerophilic environments even with high bacterial load (Azeredo J, et al. 2008. Curr Pharm Biotechnol 9:261-266). Phage cocktails in particular can provide additional advantages over the use of individual phages, e.g., to increase lytic activity against a particular bacterial strain, to increase host range, and/or to decrease the possibility of bacterial resistance emerging to an individual bacteriophage. Indeed, different bacteriophage are mixed as cocktails to broaden their properties, preferably resulting in a collectively greater antibacterial spectrum, such as an expanded host range, which makes development of resistance less likely in the subject receiving the agent.

In specific embodiments, the subject receiving a pharmaceutical composition of the invention is a mammal (e.g., bovine, ovine, caprine, equid, primate (e.g., human), rodent, lagomorph or avian (e.g., chicken, duck, goose)). In preferred embodiments, the subject receiving a pharmaceutical composition of the invention is a human, and particularly a patient that suffers from or is at risk of suffering from respiratory or pulmonary infections, including hospital-acquired bacterial pneumonia (HABP) or cystic fibrosis-associated infection.

In preferred embodiments, pharmaceutical compositions of the invention have activity against a plurality of bacterial strains. In some preferred embodiments, the pharmaceutical composition comprises a phage cocktail combination having activity against a plurality of strains of *P. aeruginosa* and/or *K. pneumonae*. Accordingly, the invention provides methods of treating and/or preventing infections associated with *P. aeruginosa* and/or *K. pneumonae* in both humans and animals using a phage, phage product, or phage cocktail composition of the invention. In other aspects, the invention provides methods of treating and/or preventing infections associated with related species or strains of these bacteria.

*P. aeruginosa* and *K. pneumonae* are responsible for many severe opportunistic infections, particularly in individuals with compromised immune systems. The pharmaceutical compositions of the present invention are contemplated for treating and/or preventing any infection associated with *P. aeruginosa* and/or *K. pneumonae*, or associated with other species or strains of bacteria, including, but not limited to, infections of the lungs and respiratory tract, post-operative infections, infections associated with catheters and surgical drains, and infections of the blood. In preferred embodiments, the pharmaceutical compositions of the invention find use in treating and/or preventing bacterial infections associated with the lungs and respiratory tract.

Respiratory and pulmonary infections include, but are not limited to, infections associated with cystic fibrosis, such as cystic fibrosis bronchiectasis; pneumonia, including hospital-acquired bacterial pneumonia, ventilator-associated pneumonia, and bronchopneumonia; non-cystic fibrosis bronchiectasis; bronchitis; chronic obstructive pulmonary disease; mycobacterial disease, post-lung transplant infection; infections associated with tuberculosis; empyema with thoracic fistula; pleuritis with fistula, lung abscesses; rhinitis; purulent cysts; and lung-derived septicemia. Symptoms of respiratory or pulmonary infections include, e.g., cough, wheezing, production of sputum, dyspnea (difficulty breathing), dysphonia (difficulty speaking), and overall decreased quality of life. In particularly preferred embodiments, the respiratory or pulmonary infection is hospital-acquired bacterial pneumonia (HABP).

Regarding HABP, the time of onset during hospitalization is an indicator of risk for specific pathogens and outcomes. With early onset, e.g., within the first 4 days of hospitalization, the most frequent agents are endogenous microbiota like *Streptococcus pneumonia* and *Haemophilus influenzae*, as well as Gram negative and community *S. aureus* sensitive to antibiotics. With late onset, e.g., onset occurring more than 5 days after being hospitalized, gram-negative bacteria account for the majority of cases, many of which are resistant to antibiotics, such as certain strains of *P. aeruginosa*, *Klebsiella pneumonia*, *Enterobacter* spp., and *Acinetobacter* spp., as well as certain *S. aureus* infections, particularly those in neurosurgical patients, diabetics, and patients with chronic renal problems (2005, *Am J Respir Crit Care Med* Vol 171(4):388:416). Strains of *P. aeruginosa, K. pneumonia* are especially relevant to late-onset HABP.

*P. aeruginosa* and *K. pneumonae* also are associated with infections that involve other organ systems that have a high fluid content, and it is contemplated that the phage cocktails of the invention have therapeutic and/or prophylactic use with respect to such infections. For example, the pharmaceutical compositions of the invention may be used for the prevention or treatment of infections of the cerebrospinal fluid, of peritoneal fluid, and of the urinary tract.

In some embodiments, the invention provides methods of treating and/or preventing respiratory or pulmonary infection, comprising administering to a subject in need thereof a therapeutically or prophylactically effective amount of a pharmaceutical composition of the instant invention. In preferred embodiments, administration results in an improvement in breathing, e.g., returning labored or rapid breathing to normal.

In a particularly preferred embodiment, the invention provides methods of treating a surprising range of *P. aeruginosa* or *K. pneumonae* bacterial strains, using a phage cocktail of the invention. For example, a phage cocktail comprising the *P. aeruginosa* phages F99/10, F27/12 and F95/13 shows efficacy against a highly diverse range of *P. aeruginosa* clinical strains (42% infection), e.g., when compared to homologous *P. aeruginosa* phage. In other embodiments, a phage cocktail comprising the *K. pneumonae* phages F391/08, Kle_F105/15, Kle_F134/15, and Kle_F141/15 shows efficacy against a highly diverse range of *K. pneumoniae* strains clinical strains, presenting varied capsular serotypes (32% infection), e.g., when compared to certain other *K. pneumoniae* phages (Kesik-Szeloch A et al., 2013, *Virol J* 10:100).

In preferred embodiments, administration comprises administration of the pharmaceutical composition via an aerosol into one or more airways of the subject, e.g., administration by inhalation. Administration by inhalation can improve drug delivery to the target site of infection (i.e., the airways) and/or limit potential for systemic side effects. Administration of the pharmaceutical composition as an aerosol includes, but is not limited to, administration by inhalation, intranasal instillation, catherization of the trachea, delivery to the pleural cavity of the lungs, or bronchoscopy (Abedon S T, 2015, *Bacteriophage*, 5(1): e1020260-1 to e1020260-13). During administration of the pharmaceutical composition as an aerosol, the bacteriophage remain viable and may be contained in particles of suitable size to reach the lower airways. For example, in particularly preferred embodiments, the majority of aerosolized particles are less than 5 μm in diameter, e.g., at least 50%, 60%, 70%, or 80% of the particles are less than 5 μm in diameter, and more preferably are about 2 μm in diameter.

For intranasal administration or administration by inhalation, the bacteriophage and/or phage product of the invention may be delivered in the form of a dry powder, fine particles, nanoparticles, solutions, lyophilized preparations, liposomal preparations, and the like. Typically the formulation comprising the phage, phage product, and/or phage cocktail of the invention is in the form of a dry powder inhaler or an aerosol spray delivered from a pressurized container, pump, spray, or nebulizer with the use of a suitable propellant, e.g., dichlorodifluoromethane, trichlorofluoromethane, dichlorotetrafluoroethane, a hydrofluoroalkane such as 1,1,1,2-tetrafluoroethane (HFA 134A™) or 1,1,1,2,3,3,3-heptafluoropropane (FIFA 227EA™), carbon dioxide, or other suitable gas.

In the case of a pressurized aerosol, the dosage unit may be determined by providing a valve to deliver a metered amount. The pressurized container, pump, spray, or nebulizer may contain a solution or suspension of the active compound, e.g., using a mixture of ethanol and the propellant as the solvent, which may additionally contain a lubricant, e.g., sorbitan trioleate. Capsules and cartridges (made, for example, from gelatin) for use in an inhaler or insufflator may be formulated to contain a powder mix of the phage, phage product, and/or phage cocktail of the invention and a suitable powder base such as lactose or starch.

Nebulization may be achieved using any known means in the art or as described herein. Typically, nebulization is achieved by jet nebulizers, which use air or oxygen under high pressure to generate the aerosol. Other nebulizers include vibrating mesh nebulizers, driven by piezoelectric actuators, which reduce size variability and reduce nebulization time. Another approach comprises mechanical ventilation, where the nebulizer is connected to the inspiratory limb of the ventilator circuit. Still another approach uses emulsion-based "spray-drying" to transform a solution or emulsion from a fluid state into fine particles with uniform size distribution (about 1-5 μm). Two typical classes of nebulizers include the AeroEclips (Trudell Medical International), a jet nebulizer where nebulization only occurs when the patient inhales; and the Omron (Omron, MicroAir U22), a battery-powered mesh nebulizer that relies on the vibration of a piezoelectric crystal to force the agents through a fine mesh, creating an aerosol (Sahota et al., 2015, *J. Aerosol Medicine and Pulmonary Drug Delivery* 28(0): 1-8). In some preferred embodiments, a SYSTAM L290 (SYSTAM, Villeneuve Sur Lot, France) nebulizer is used. This nebulizer produces an ultrasonic aerosol where about 70% of the particles are less than 5 m diameter.

Pharmaceutical compositions of the invention will comprise a therapeutically and/or prophylactically effective amount of one of more phages or phage products, as described herein. A therapeutically and/or prophylactically effective amount refers to an amount required to bring about a therapeutic and/or prophylactic benefit, respectively, in a subject receiving said amount. A therapeutically and/or prophylactically effective amount will depend on the particular formulation, route of administration, condition being treated, whether other agents or therapies are used in combination with methods of the invention, and other factors.

In some embodiments, the pharmaceutical composition is delivered to a subject in need thereof so as to provide one or more bacteriophage in an amount corresponding to a multiplicity of infection (MOI) of about 1 to about 10. MOI is determined by assessing the approximate bacterial load in the lungs (e.g., $2 \times 10^6$ cfu/g of lung in the murine model used in the Examples), or calculating the bacterial load in the lungs of a particular patient, or using an estimate for a given type of respiratory infection; and then providing phage in an amount calculated to give the desired MOI (e.g., $2 \times 10^7$ pfu/g of lung gives a MOI of 10 in the murine model). MOI may be selected based on the "multiplicity of 10 rule", which states that where there are on average in order of 10 phages adsorbed per bacterium, bacterial density reduces significantly (Abedon S T, 2009, Foodborne Pathog Dis 6:807-815; and Kasman L M, et al., 2002, J Virol 76:5557-5564); whereas lower-titer phage administration (e.g., using a MOI lower than 10) is unlikely to be successful (Goode D, et al., 2003, App Environ Microbiol 69:5032-5036; Kumari S, et al., 2010, J Infect Dev Ctries 4:367-377).

In some preferred embodiments, a phage cocktail comprising F99/10 and F110/10, delivered to provide a MOI between 1 and 10 of each phage, results in a decrease in P. aeruginosa in the lungs by about 80%, about 85%, about 95%, about 97%, about 98%, or by as much as about 100% (where viable cell count decreases to zero). In some preferred embodiments, a phage cocktail comprising F99/10, F27/12 and F95/13, delivered to provide a MOI between 1 and 10 of each phage, results in a decrease in P. aeruginosa in the lungs by about 80%, about 85%, about 95%, about 97%, about 98%, or by as much as about 100%. In some particularly preferred embodiments, the phage cocktail comprising F99/10, F27/12 and F95/13 surprisingly shows synergistic bacteriolytic action.

In some embodiments, lower doses surprisingly provide advantages over higher doses. For example, in some embodiments, a MOI at or about 1 maintains low levels of bacteria in the lungs for longer periods of time than a MOI at or about 10. For example, lower MOI's of F99/10, F27/12 and F95/13 may achieve lower P. aeruginosa load in the lungs of infected animals for longer periods of time post-treatment, e.g., for 12 hours, 15 hours, 18 hours, 24 hours, 30 hours, 36 hours, or longer post-treatment. Without wishing to be bound by theory, this may be due to delay in the appearance of bacterial resistance in response to the lower doses of phage.

In some other embodiments, a MOI as low as about 0.2 to 0.4 surprisingly results in efficacy, e.g., delivering a phage cocktail comprising F99/10, F27/12 and F95/13, to provide a MOI of about 0.2 to 0.4 of each phage, can provide statistically significant reductions in P. aeruginosa load in the lungs of infected animals. Without being bound to a particular theory, efficacy may be due to active therapy. That is, phage doses at a MOI of 10 provide phage sufficiently in excess of the target bacteria population to reduce bacterial load without the need for phage replication or life cycle completion. Lower phage doses may rely on active therapy, which involves phage infection/replication cycles to reduce the target bacterium (Loc Carrillo C, et al., 2005, Appl Environ Microbiol 71:6554-6563; see also Cairns B J, et al., 2009, PLoS Pathog 5:e1000253; and Hooton S P, et al., 2011, Int J Food Microbiol 151:157-163).

In certain embodiments, a phage, phage product, or phage cocktail composition of the invention is used as a single agent for treating or preventing infections caused by P. aeruginosa and/or K. pneumonae, such as respiratory or pulmonary infections. In other embodiments, a phage cocktail of the invention is used in further combination with other agents, including standard antibiotics that target the same or different kinds of bacteria, including bacteria selected from any gram-positive bacteria, any gram-negative bacteria, and any other groups of bacteria that is not classified as gram-positive or gram-negative. The compositions of the invention may also be used in combination with any other means of treating bacterial infection known to one of skill in the art, in particular, any other means of treating respiratory infections.

In some particularly preferred embodiments, the invention provides methods of treating and/or preventing respiratory or pulmonary infections comprising administering a phage cocktail of the invention in combination with a standard and/or non-standard therapy. Standard therapies for respiratory infections includes inhalation and/systemic administration of antibiotic agents such as tobramycin, amikacin, colistin, aztreonam, as well as levofloxacin, ceftazidime, fosfomycin, gentamicin, vancomycin, amphotericin, capreomycin, fifampin, isoniazid, and ciproflaxin; and inhalation and/or systemic administration of antifungal agents such as amphotericin B.

In some embodiments, the phage, phage product, or phage cocktail composition of the invention is administered as an aerosol, while an additional agent is administered systemically. For example, in some preferred embodiments, a phage cocktail composition of the invention is administered by inhalation while an antibiotic agent is administered systemically, such as an antibiotic agent having activity against P. aeruginosa and/or K. pneumonea. In some embodiments, the phage cocktail composition of the invention is administered via inhalation along with an additional agent that also is administered as an aerosol. For example, in some preferred embodiments, the phage cocktail composition of the invention is administered along with another antibiotic agent or an antifungal agent as an aerosol into the lungs.

In some embodiments, the invention provides methods of treating and/or preventing respiratory or pulmonary infections comprising administering a phage, phage product, or phage cocktail composition of the invention in combination with a non-standard therapy for respiratory infections. Non-standard therapies generally are used where the respiratory infection is refractory to one or more standard therapies.

Disinfectant and Anti-Infective Use

Bacterial pathogens most often infect at mucus membranes (e.g., through mucus membranes of the upper or lower respiratory tract, though the urogenital system, ocular structures, and the like). The mucus membranes themselves are often a reservoir, sometimes the only reservoir, for pathogenic bacteria found in the environment. There are very few anti-infectives designed to control this reservoir for pathogenic bacteria, though studies have shown that reducing or eliminating this reservoir, especially in environments such as hospitals and nursing homes, markedly reduces the incidence of infections.

The phages, phage products, and phage cocktails of the invention can be used in anti-infective compositions for controlling the growth of bacteria, in particular K. pneumoniae and P. aeruginosa, in order to prevent or reduce the incidence of nocosomial infections. The anti-infective compositions find use in reducing or inhibiting colonization or growth of bacterial on a surface connected therewith. The phages, phage products, and phage cocktails of the invention may be incorporated into compostions that are formulated for application to biological surfaces, such as the skin and mucus membranes, as well as for application to non-biological surfaces.

Anti-infective formulations for use on biological surfaces include, but are not limited to, gels, creams, ointments, sprays, and the like. In particular embodiments, the anti-infective formulation is used to sterilize a surgical field, or the hands and/or exposed skin of healthcare workers and/or patients. In preferred embodiments, the biological surface is a mucus membrane of a mammal, more preferably, the mucus membrane of a human. In particularly preferred embodiments, the biological surface is a mucus membrane of the respiratory tract, such as the nasal mucosa, linings of the pharynx, lyrynx, trachea, bronchi, and/or lungs.

Anti-infective formulations for use on non-biological surfaces include sprays, solutions, suspensions, wipes impregnated with a solution or suspension, and the like. In particular embodiments, the anti-infective formulation is used on solid surfaces in hospitals, nursing homes, ambulances, etc., including, e.g., appliances, countertops, and medical devices, hospital equipment. In preferred embodiments, the non-biological surface is a surface of a hospital apparatus or piece of hospital equipment. In particularly preferred embodiments, the non-biological surface is a surgical apparatus or piece of surgical equipment.

Diagnostic Methods

The present invention also encompasses diagnostic methods for determining the causative agent in a bacterial infection. In certain embodiments, the diagnosis of the causative agent of a bacterial infection is performed by (i) culturing a sample from a patient, e.g., a swab, sputum, or other sample appropriate for culturing the bacteria causing the infection; (ii) contacting the culture with one or more phages, phage products, and phage cocktails of the invention; and (iii) monitoring for evidence of cell growth and/or lysis of the culture. Because the activity of phages and/or their isolated products (e.g., polypeptides, biologically active fragments or variants thereof, or nucleic acids encoding same) tends to be species or strain specific, susceptibility, or lack of susceptibility, to one or more phages, phage products, and phage cocktails of the invention can indicate the species or strain of bacteria causing the infection.

In some embodiments, a test culture is obtained from a patient and contacted with one or more phages comprising a nucleic acid that comprises/consists of the nucleotide sequence of any of SEQ ID NOs: 1-5, or a variant thereof, phage product thereof, including a phage protein (e.g. a lysin or a tail protein), variant or fragment thereof, or a nucleic acid encoding same. Decreased growth and/or lysis of the culture can indicate that the test sample comprises *P. aeruginosa*, in particular, a strain of *P. aeruginosa* susceptible to infection by the phage, phage product, or phage cocktail used, as disclosed herein, thereby identifying the infective agent and allowing appropriate diagnosis and/or treatment.

In some embodiments, a test culture is obtained from a patient and contacted with one or more phages comprising a nucleic acid that comprises/consists of the nucleotide sequence of any of SEQ ID NOs:6-10, or a variant thereof, phage product thereof, including a phage protein (e.g. a lysin or a tail protein), variant of fragment thereof, or a nucleic acid encoding same. Decreased growth and/or lysis of the culture can indicate that the test sample comprises *K. pneumoniae*, in particular, a strain of *K. pneumoniae* susceptible to infection by the phage, phage product, or phage cocktail used, as disclosed herein, thereby identifying the infective agent and allowing appropriate diagnosis and/or treatment.

The sample may be a tissue biopsy or swab collected from the patient, or a fluid sample, such as blood, tears, or urine. In preferred embodiments, the tissue sample is obtained from the respiratory tract of the patient, e.g., a mucus sample, sputum, or a swab from a nostril.

Amino Acid Variants

The invention also encompasses amino acid sequence variants. In some embodiments, they may be substitutional, insertional and/or deletion variants. Deletion variants lack one or more residues of the native protein which typically are not essential for function (e.g., antibacterial activity). Insertional mutants typically involve the addition of material at a non-terminal point in the polypeptide. Substitutional variants typically involve the exchange of one amino acid for another at one or more sites within the polypeptide, and may be designed to modulate one or more properties of the polypeptide, such as stability against proteolytic cleavage, preferably without the loss (or substantial loss) of other functions or properties. Substitutions of this kind preferably are conservative, that is, one amino acid is replaced with one of similar shape and charge. Conservative substitutions are well known in the art and include, for example, the changes of: alanine to serine; arginine to lysine; asparagine to glutamine or histidine; aspartate to glutamate; cysteine to serine; glutamine to asparagine; glutamate to aspartate; glycine to proline; histidine to asparagine or glutamine; isoleucine to leucine or valine; leucine to valine or isoleucine; lysine to arginine; methionine to leucine or isoleucine; phenylalanine to tyrosine, leucine or methionine; serine to threonine; threonine to serine; tryptophan to tyrosine; tyrosine to tryptophan or phenylalanine; and valine to isoleucine or leucine.

Once general areas of a gene are identified as encoding a particular antibacterial activity, e.g., being identified as a lysin as described herein, point mutagenesis may be employed to identify with greater particularity which amino acid residues are important in the antibacterial activity. One of skill in the art can generate, for example, single base changes in the DNA strand to result in an altered codon and/or a missense mutation that preserves desired function.

Preferably, mutation of the amino acids of a protein creates an equivalent, or even an improved, second-generation molecule. For example, certain amino acids may be substituted for other amino acids in a protein structure without detectable or substantial loss of function (e.g., antibacterial activity). In making such changes, the hydropathic index of amino acids may be considered. The importance of the hydropathic amino acid index in conferring interactive biological function on a protein is generally understood in the art. It is accepted that the relative hydropathic character of the amino acid contributes to the secondary structure of the resultant protein, which in turn defines the interaction of the protein with other molecules, for example, interaction with a peptidoglycan within the outer coat of a gram-positive bacteria. Each amino acid has been assigned a hydropathic index on the basis of their hydrophobicity and charge characteristics; for example: isoleucine(+4.5); valine(+4.2); leucine(+3.8); phenylalanine (+2.8); cysteine/cystine(+2.5); methionine(+1.9); alanine(+1.8); glycine(−0.4); threonine(−0.7); serine(−0.8); tryptophan 0.9); tyrosine(−1.3); proline(−1.6); histidine(−3.2); glutamate(−3.5); glutamine(−3.5); aspartate (−3.5); asparagine (−3.5); lysine (−3.9); and arginine (−4.5). It is also understood in the art that the substitution of like amino acids can be made effectively on the basis of hydrophilicity. Like hydrophobicity, values of hydrophilicity have been assigned to each amino acid: arginine (+3.0); lysine (+3.0); aspartate (+3.0+1); glutamate (+3.0+1); serine (+0.3); asparagine (+0.2); glutamine (+0.2); glycine (0); threonine (−0.4); proline (−0.5+1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). Equivalent molecules may be obtained by substitution of one amino acid for another where their hydropathic and/or their hydrophilicity indices are within +2, preferably +1, or most preferably +0.5 of each other.

In certain embodiments, the invention encompasses isolated polypeptides that comprise 1, 2, 3, 4, 5, 6, 7, 8, 9, or 10 or more amino acid modifications (e.g., insertion, substitution, deletion, etc.) relative to an amino acid sequence disclosed herein. In preferred embodiments, the mutation(s) are made such that biological activity of the parent polypeptide is retained or substantially retained. For example, the invention encompasses polypeptides from bacteriophage F99/10, F27/12, or F95/13, which are mutated to comprise 1, 2, 3, 4, 5, 6, 7, 8, 9, or 10 or more amino acid modifications and that retain/exhibit antibacterial activity against one or more strains *P. aeruginosa*. In some embodiments, the invention encompasses polypeptides from bacteriophage F92/15, F105/15, F134/15, and F141/15, which are mutated to comprise 1, 2, 3, 4, 5, 6, 7, 8, 9, or 10 or more amino acid modifications and that retain/exhibit antibacterial activity against one or more strains *K. pneumoniae*.

Polynucleotides Encoding Polypeptides of the Invention

The invention provides polynucleotides (nucleic acids) comprising a nucleotide sequence encoding a polypeptide of the invention. The invention also encompasses polynucleotides that hybridize under high stringency, intermediate, or lower stringency hybridization conditions to polynucleotides that encode a polypeptide of the invention and that encode modified polypeptides that have antibiotic and/or other biological activity.

The polynucleotides may be obtained, and the nucleotide sequence determined, by any method known in the art. For example, a polynucleotide encoding a polypeptide of the invention may be generated from nucleic acid from a suitable source (e.g., *Pseudomonas aeruginosa* bacteriophage F99/10, F27/12, and Psa_F95/13, *Klebsiella pneumoniae* bacteriophage F391/08, Kle_F92/15, Kle_F105/15, Kle_F134/15, and Kle_F141/15). Nucleotide sequences may be isolated from phage genomes by routine methods known in the art (see, e.g., Carlson, "Working with bacteriophage: common techniques and methodological approaches," In, Kutter and Sulakvelidze (Eds) Bacteriophage: Biology and Applications, 5th ed. CRC Press (2005); incorporated herein by reference in its entirety); or as described herein in the Examples. If a source containing a nucleic acid encoding a particular polypeptide is not available, but the amino acid sequence of the polypeptide of the invention is known, a nucleic acid encoding the polypeptide may be chemically synthesized and cloned into replicable cloning vectors using any method known in the art.

Once the nucleotide sequence of a polypeptide of the invention is determined, the nucleotide sequence may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al, eds., 1998, Current Protocols in Molecular Biology, John Wiley & Sons, NY, which are both incorporated by reference herein in their entireties), to generate polypeptides having a different amino acid sequence, for example, to create amino acid substitutions, deletions, and/or insertions.

Recombinant Expression of Molecules of the Invention

Once a nucleic acid comprising a nucleotide sequence encoding a polypeptide of the invention has been obtained, the vector for the production of the molecules may be produced by recombinant DNA technology using techniques well known in the art. Methods well known to those skilled in the art can be used to construct expression vectors containing the coding sequences with appropriate transcriptional and translational control signals. These methods include, for example, in vitro recombinant DNA techniques, synthetic techniques, and in vivo genetic recombination. (See, for example, the techniques described in Sambrook et al, 1990, Molecular Cloning, A Laboratory Manual, 2d Ed., Cold Spring Harbor Laboratory, Cold Spring Harbor, N.Y.; and Ausubel et al. eds., 1998, Current Protocols in Molecular Biology, John Wiley & Sons, NY).

The present invention provides expression vectors encoding the phage proteins of the invention, and biologically active fragments or variants thereof. An expression vector comprising a nucleic acid having the nucleotide sequence of a molecule of the invention can be transferred to a host cell by conventional techniques (e.g., electroporation, liposomal transfection, calcium phosphate precipitation, and the like) and the transfected cells then can be cultured by conventional techniques to produce polypeptides of the invention. In preferred embodiments, the host cell is other than the species of the parent bacteria from which the bacteriophage comprising the sequence was derived. In specific embodiments, expression of the polypeptide is regulated by a constitutive, an inducible, or a tissue-specific promoter. In specific embodiments, the expression vector is pQE-30 (Qiagen) or pET-29(a) (Novagen).

A variety of host-expression vector systems may be used. Such host-expression systems represent vehicles by which the coding sequences of polypeptides of the invention may be produced and subsequently purified, but also represent cells that, when transformed or transfected with the appropriate encoding nucleic acids, express polypeptides of the invention in situ.

The host cells used to express polypeptides of the invention may be bacterial cells that are or that are not susceptible to the bacteriophage, phage protein, or variant or fragment thereof of the invention. For example, in some embodiments, the host cell used is *P. aeruginosa* 114/12 strain, *P. aeruginosa* 460/06 strain, *P. aeruginosa* 433/07 strain, *P. aeruginosa* 66/09 and/or *P. aeruginosa* 1992/05 strain. In some particular examples, *P. aeruginosa* 114/12 strain is used to express a polypeptide of phage F27/12; *P. aeruginosa* 460/06 strain is used to express a polypeptide of phage F99/10; *P. aeruginosa* 433/07 strain is used to express a polypeptide of any of phages F99/10, and F27/12; *P. aeruginosa* 66/09 is used to express a polypeptide of phage Psa_F95/13 and *P. aeruginosa* 1992/05 is used to express a polypeptide of any of phages F99/10, F27/12 and F95/13. In some embodiments, for example, the host cell used is *K. pneumoniae* 573/07 strain, *K. pneumoniae* 223/14 strain, *K. pneumoniae* 397/07 strain, *K. pneumoniae* 1633/05 strain, and/or *K. pneumoniae* 241/14 strain. In some particular examples, a polypeptide of phage F391/08 is expressed in *K. pneumoniae* 573/07 strain; a polypeptide of phage Kle_F92/15 is expressed in *K. pneumoniae* 223/14 strain; a polypeptide of phage Kle_F105/15 is expressed in *K. pneumoniae* 1633/05 strain; a polypeptide of Kle_F134/15 is expressed in *K. pneumoniae* 397/07 strain; and a polypeptide of Kle_F141/15 is expressed in *K. pneumoniae* 241/14 strain.

In some embodiments, bacteria are used that are not susceptible to the bacteriophage, phage protein, or variant or fragment thereof of the invention (e.g., *B. subtilis*). In either case, the bacterium can be transformed with recombinant phage DNA, plasmid DNA, or cosmid DNA expression vectors containing coding sequences for polypeptides of the invention.

In some embodiments, other microorganism are used as the host-expression system, such as yeast (e.g., *Saccharo-*

*myces pichia*) transformed with recombinant yeast expression vectors containing sequences encoding polypeptides of the invention; insect cell systems infected with recombinant virus expression vectors (e.g., baculovirus) containing the sequences encoding polypeptides of the invention; plant cell systems infected with recombinant virus expression vectors (e.g., cauliflower mosaic virus (CaMV) and tobacco mosaic virus (TMV)) or transformed with recombinant plasmid expression vectors (e.g., Ti plasmid) containing sequences encoding polypeptides of the invention; or mammalian cell systems (e.g., COS, CHO, BHK, 293, 293T, 3T3 cells, lymphotic cells (see U.S. Pat. No. 5,807,715), or Per C.6 cells (human retinal cells)) containing sequences encoding polypeptides of the invention in recombinant expression constructs, along with promoters derived from the genome of mammalian cells (e.g., a metallothionein promoter) or from mammalian viruses (e.g., the adenovirus late promoter or the vaccinia virus 7.5K promoter).

In bacterial systems, different expression vectors may be selected depending upon the intended use of the polypeptide being expressed. For example, when large quantities of protein are desired, e.g., for pharmaceutical compositions comprising a polypeptide of the invention, vectors that direct expression of high levels of protein products are used, particularly where the expressed product can be readily purified, e.g., if expressed as a fusion construct that can be readily purified. Such vectors include, but are not limited to, the *E. coli* expression vector pUR278 (Ruther et al., 1983, *EMBO J.* 2: 1791) in which the coding sequence is ligated into the vector in frame with the lac Z coding region so that a fusion protein is produced; pIN vectors (Inouye & Inouye, 1985, *Nucleic Acids Res.* 13:3101-3109; Van Heeke & Schuster, 1989, *J. Biol. Chem.* 24:5503-5509); and the like. pGEX vectors may also be used to express foreign polypeptides as fusion proteins, in this case, with glutathione S-transferase (GST). In general, such fusion proteins are soluble and can easily be purified from lysed cells by adsorption to a matrix of glutathione-agarose beads, followed by elution using free gluta-thione. The pGEX vector can be designed to include thrombin or factor Xa protease cleavage sites, so that the target gene product can be released from the GST moiety.

In an insect system, *Autographa californica* nuclear polyhedrosis virus (AcNPV) can be used as a vector to express foreign genes. The virus preferably grows in *Spodoptera frugiperda* cells. The polypeptide coding sequence may be cloned into non-essential regions (e.g., the polyhedrin gene) of the virus and placed under the control of an AcNPV promoter (e.g., the polyhedrin promoter).

Once a polypeptide of the invention has been recombinantly expressed, it may be purified by any method known in the art for purification of polypeptides, for example, by chromatography (e.g., ion exchange, affinity, and sizing column chromatography), centrifugation, differential solubility, or by any other standard technique for the purification of polypeptides.

Examples

It is understood that the following examples and embodiments described herein are for illustrative purposes only and that various modifications or changes in light thereof will be suggested to persons skilled in the art and are to be included within the spirit and purview of this application and the scope of the appended claims.

Unless otherwise indicated, specific bacteriophage disclosed herein were isolated, processed and analyzed according to the following methods. Further, the study described below was approved locally by the Animal Ethics Committee of the Instituto de Medicina Molecular and approved nationally by the Portuguese General Directorate of Veterinary Services (Direcção Geral de Veterinária), in accordance with Portuguese law. All animals in the study were maintained in accordance with European Directive 86/609/EC (Council of the European Communities. Council Directive 86/609/EEC of 24 Nov. 1986 on the approximation of laws, regulations and administrative provisions of the Member States regarding the protection of animals used for experimental and other scientific purposes. *Off J Eur Communities* L358:1-28), Portuguese law (Portaria 1005/92) (Portuguese Agricultural Ministry. Portaria no. 1005/92 of 23 October on the protection of animals used for experimental and other scientific purposes. *Didário da República I—Série B* 245: 4930-4942), and the *Guide for the Care and Use of Laboratory Animals* (NRC 2011) (Institute for Laboratory Animal Research. 2011. Guide for the care and use of laboratory animals. Washington (DC): National Academies Press.).

One aim of this study was to investigate the antimicrobial activity of a nebulized bacteriophage cocktail against *Pseudomonas aeruginosa* and *Klebsiella pneumoniae* in a murine experimental model of acute pulmonary infection. Nebulization of aerosolized bacteriophage allowed delivery directly to affected lung areas, overcoming certain side effects of nebulized antibiotics.

Preparation of Bacterial Strains

*Pseudomonas aeruginosa* 114/12, 460/06, 433/07, 66/09, 1992/05 and *Klebsiella pneumoniae* 223/14, 397/07, 1633/05, 241/14 strains were isolated from human clinical samples collected and identified in hospitals from the Lisbon area. In addition, 100 *P. aeruginosa* and 103 *K. pneumoniae* clinical strains were isolated for evaluating the infection abilities of bacteriophages of the invention. Of the 100 *P. aeruginosa* strains, 52 were analyzed by Pulse Field Gel Electrophoresis (PFGE) and showed distinct molecular profiles (Kaufmann M E, 1998, *Protocols and Clinical Applications*, Humana Press Inc., pages 33-50, and Tenover F, et al., 1995, *J Clin Microbiol* 33(9):2233-2239). Also 10 representative isolates of *P. aeruginosa* strains were characterized by Multilocus Sequence-Typing (MLST) that allowed the typing of the bacterial isolates in sequence-types (STs) (23, 24, Curran et al, 2004).

Strains of *K. pneumoniae*, particularly clinical isolates frequently produce a viscous polysaccharide capsule. The biochemical complexity of these capsules gives rise to the production of strain-specific antigenic types of capsular material (Clegg S, et al, 2016, *Microbiol Spectr* 4(1)). In this study, 73 of the 103 *K. pneumoniae* clinical strains were previously characterized for capsular serotype by commercially available antisera against *K. pneumoniae* antigens and were kindly provided by Prof. Aida Duarte. The capsular serotypes represented by these strains were: 15 K2, 8 K3, 5 K8, 8 K15, 1 K16, 1 K19, 1 K20, 1 K21, 3 K24, 1 K26, 1 K28, 1 K30, 1 K35, 1 K44, 4 K55, 3 K68, 1 K8,47, 1 K6,68, 1 K8,35,55, 12 O:1 (without capsule, O antigen identified), 1 O:5 (without capsule, O antigen identified), 2 neg (capsular strains without serotype identification).

Each bacterial isolate was streaked onto tryptone soy agar media plates (TSA, Biokar Diagnostics, Pantin Cedex, France) and incubated at +37° C. for 18 h. All clinical strains were stored in tryptone soy broth (TSB, Biokar Diagnostics, Pantin Cedex, France) with 15% glycerol (w/v) at −70° C. until needed.

Cryopreserved strains at −70° C. were grown overnight on TSA at 37° C.

For in vitro experiments, single colonies were grown overnight in TSB at 37° C. with agitation. A new bacterial suspension (a dilution of the overnight culture) was prepared and incubated at 37° C. with agitation. Bacteria were harvested upon reaching the exponential growth phase (having an optical density at 600 nm of 0.3-0.5). An inoculum of approximately $2.0 \times 10^6$ cfu/ml was used for generating the lysis curves.

For in vivo experiments, single colonies were grown overnight on TSB at 37° C. A new bacterial suspension (a dilution of the overnight culture) was prepared and bacteria were harvested and concentrated by high speed centrifugation, upon reaching the exponential growth phase. A 6 ml bacterial suspension was prepared in NaCl 0.9% and used in the nebulization of each clinical strain at approximately $2.0 \times 10^{10}$ cfu/ml.

Preparation of Bacteriophage Strains

The following virulent bacteriophages were isolated from sewage water from the Lisbon area: *Pseudomonas aeruginosa* F99/10, F27/12, Psa_F95/13, *Klebsiella pneumoniae* F391/08, Kle_F92/15, Kle_F105/15, Kle_F134/15, and Kle_F141/15. The phages were amplified in clinical bacterial strains as follows: phages F99/10, F27/12 and Psa_F95/13 were amplified in *P. aeruginosa* 1992/05; phage F27/12 was amplified in *P. aeruginosa* 114/12; phage Psa_F95/13 was amplified in *P. aeruginosa* 66/09; phages F99/10, F27/12, Psa_F95/13 were amplified in *P. aeruginosa* 1992/05; phage F391/08 was amplified in *K. pneumoniae* 573/07; phage Kle_F92/15 was amplified in *K. pneumoniae* 223/14; phage Kle_F105/15 was amplified in *K. pneumoniae* 1633/05; Kle_F134/15 was amplified in *K. pneumoniae* 397/07; and Kle_F141/15 was amplified in *K. pneumoniae* 241/14.

The present inventors have isolated several lytic phages active against genetically diverse (as assessed by pulsed field gel electrophoresis and/or arbitrary pruned polymerase chain reaction or other nucleic acid amplification techniques) TechnoPhage collection strains. In vitro susceptibility tests resulted in the TechnoPhage collection being able to cumulatively lyse all TechnoPhage strains in the collection, with one particular phage being able to lyse at least 90% of TechnoPhage strains.

To isolate lytic bacteriophages against *P. aeruginosa* and *K. pneumoniae*, several clinical strains were used. Sewage water from different origins of the Lisbon urban area was tested for the ability to infect various *P. aeruginosa* and/or *K. pneumoniae* clinical strains by a double agar overlay plaque assay (Kropinsk A, et al., 2009, *Methods Mol Biol* 501:69-76).

Briefly, the bacterial strains were grown overnight in TSB at 37° C. with agitation. A new bacterial suspension (dilution of the overnight culture) was prepared, incubated at 37° C. with agitation and harvested upon reaching the exponential growth phase (optical density at 600 nm 0.3-0.5). Each culture was added to a water sample and the mixture was incubated at 37° C. for 30 minutes, followed by addition of 3 ml of 0.7% soft agar, pre-equilibrated. The agar-water-bacterial suspension was overlaid onto TSA plates 1.5%, allowed to solidify at room temperature, and incubated at 37° C. After 18 hours of incubation, the plates were checked for the presence of phage plaques (clear zones) within the bacterial lawn, indicating the presence of bacteriophages. Bacteriophage plaques were picked using sterile pipette tips, transferred to SM buffer, and stored at 4° C.

Phage Propagation and Characterization

Before evaluation of host range, the newly isolated bacteriophages were subjected to a process of propagation, amplification, and purification (using 3 consecutive elutions) in the indicator strains. Susceptibility of 30 *P. aeruginosa* and *K. pneumoniae* bacterial isolates to a particular bacteriophage infection was performed using the double agar overlay plaque assay. Briefly, the bacterial strains were grown overnight in TSB at 37° C. with agitation. A new bacterial suspension (dilution of the overnight culture) was prepared, incubated at 37° C. with agitation and harvested upon reaching the exponential growth phase (optical density at 600 nm 0.3-0.5). Each culture was added to a previous dilution of the isolated bacteriophage and the mixtures were incubated at 37° C. for 30 minutes, followed by addition of 3 ml of 0.7% soft agar, pre-equilibrated. The agar-bacteriophage-bacterial suspension was overlaid onto TSA plates 1.5%, allowed to solidify at room temperature and incubated at 37° C. Plates were allowed to dry at room temperature before incubation overnight at 37° C. The sensitivity of 30 bacterial isolates towards a particular bacteriophage was determined by observing the appearance of phage plaques within the bacterial lawn, which indicates the presence of bacteriophages.

The bacteriophages with the greatest host range were selected and subjected to subsequent processes of amplification, concentration by high speed centrifugation, purification in cesium chloride (CsCl) gradient, extraction of bacteriophage genomic DNA, and analysis by restriction fragment length polymorphism and transduction assays. Generalized transducing phages arise when phage genome fragments of the host DNA are packaged, by mistake, into phage heads in place of phage DNA. The process is called generalized transduction because any part of the host genome can be packaged and transferred in this way. This ability is tested by the amplification of a specific host gene by PCR. The gene should have several copies in the host genome and be very conserved among bacteria. The test is based on the amplification of the 16s rRNA gene in lysates of the phages (Beumer et al, 2005; Del Casale et al, 2011).

The bacteriophages that reached this phase were tested individually for host range using 100 bacterial isolates of *P. aeruginosa* and 103 bacterial isolates of *K. pneumoniae*. Those showing high percentage of infection were selected for genome sequencing. After bioinformatics analysis, the most promising bacteriophages were selected for the composition of a therapeutic cocktail.

The morphology of each of *P. aeruginosa* F99/10, F27/12 and F95/13 bacteriophages was analyzed by transmission electron microscopy at the Felix d'Herelle Reference Center for Bacterial Viruses, Laval University, Quebec, Canada. Psa_F95/13 was analyzed at the Histology and Comparative Pathology Laboratory of Institute of Molecular Medicine, Lisbon, Portugal. These data were integrated with the genomic analysis, and these bacteriophages were classified according to the Ackermann classification (Ackermann, 2009, *Methods Mol Biol* 501:69-76).

The morphology of *K. pneumoniae* F391/08, Kle_F92/15 and Kle_F105/15 bacteriophages were analyzed at the Histology and Comparative Pathology Laboratory of Institute of Molecular Medicine, Lisbon, Portugal. These data were also integrated with the genomic analyses, allowing classification of the phages according to the Ackermann classification (Ackermann, 2009, *Methods Mol Biol* 501:69-76).

Phage Cocktails In Vitro Efficacy

Bacteriophage cocktail compositions first were assessed using in vitro assays. Lysis cultures were carried out using individual phage, and combinations thereof, to observe the effectiveness of the selected *P. aeruginosa* F99/10, F27/12, and Psa_F95/13 and *K. pneumoniae* F391/08, Kle_F92/15 and Kle_F105/15 bacteriophages. The other bacteriophages were similarly tested. The in vitro studies provided a basic understanding for establishing bacteriophage therapy protocol for use in the animal models.

In vitro assays evaluated the lytic activity of *P. aeruginosa* F99/10, F27/12 and F95/13 bacteriophages, individually and when combined, in liquid cultures against *P. aeruginosa* 1992/05 strain. These assays were similar to time-kill curves (Rizvi M, et al., 2013, *J Global Antimicrob Resist* 1:103-108) used to determine the bactericidal or bacteriostatic activity of antimicrobials. Also, in vitro assays evaluated the lytic activity of the bacteriophages in single cultures or combined in liquid cultures against *K. pneumoniae* 121/15 strain. Briefly, bacterial strains were grown overnight in TSB at 37° C. with agitation. A new bacterial suspension (dilution of the overnight culture) was prepared, incubated at 37° C. with agitation, and harvested upon reaching the exponential growth phase. For each bacterium, three liquid cultures were prepared and assays performed simultaneously. A control culture of bacteria was inoculated with medium and about $2.0 \times 10^6$ cfu/ml of bacteria in the exponential growth phase. A control culture of bacteriophage was inoculated with medium and the bacteriophage to be tested, at a predetermined multiplicity of infection. Each test culture was inoculated with medium, the bacteriophage to be tested at a predetermined multiplicity of infection, and about $2.0 \times 10^6$ cfu/ml in the exponential growth phase. Cultures were incubated at 37° C. with low agitation and samples were taken from each culture at time point t=0, and then at 1 hour intervals for an 8 hour period, and then again after 24 hours of incubation.

Viable bacteria counts were quantified by the 10-fold serial dilution method (Murray P R, et al, 2003, *Manual of clinical microbiology*. Washington, D.C.: ASM Press). For the control cultures of bacteria and the test cultures, 100 μl of each dilution was spread onto cetrimide agar plates (Biokar Diagnostics, Pantin Cedex, France) or HiCrome *Klebsiella* Selective Agar Base plates (HiMedia Laboratories, Mumbai, India) for the *P. aeruginosa* and *K. pneumoniae* cultures, respectively. The plates were incubated under aerobic conditions at 37° C. for 24 hours, after which colony counts were performed. For the control cultures of bacteriophages, 100 μl aliquots were taken at time point t=0 and immediately diluted to determine the initial concentration of each bacteriophage by the double agar overlay plaque assay. After plate incubation, the bacteriophage titer was determined by enumeration of the plaque forming units (pfus).

Following the in vitro assays for F99/10, F27/12, F95/13, of F391/08, Kle_F92/15 and Kle_F105/15 bacteriophages, individually and combined, with MOI of 1 and 10, a bacteriophage cocktail was prepared in NaCl 0.9% for testing in animal experiments.

Phage Cocktail In Vivo Efficacy in Rat Models

A murine experimental model of acute pulmonary infection was adapted for *Pseudomonas aeruginosa* infection. Nebulization was used for inoculating mice with bacteria, as well as for delivering a bacteriophage cocktail of the invention, composed with *P. aeruginosa* F99/10, F27/12 and F95/13 bacteriophages, for treating established acute pulmonary infection. In this assay was used an antibiotic as comparator. Colistin was the antibiotic used due to its importance in the treatment of infections caused by *P. aeruginosa* resistant to carbapenems.

Nebulization

Figure 1:
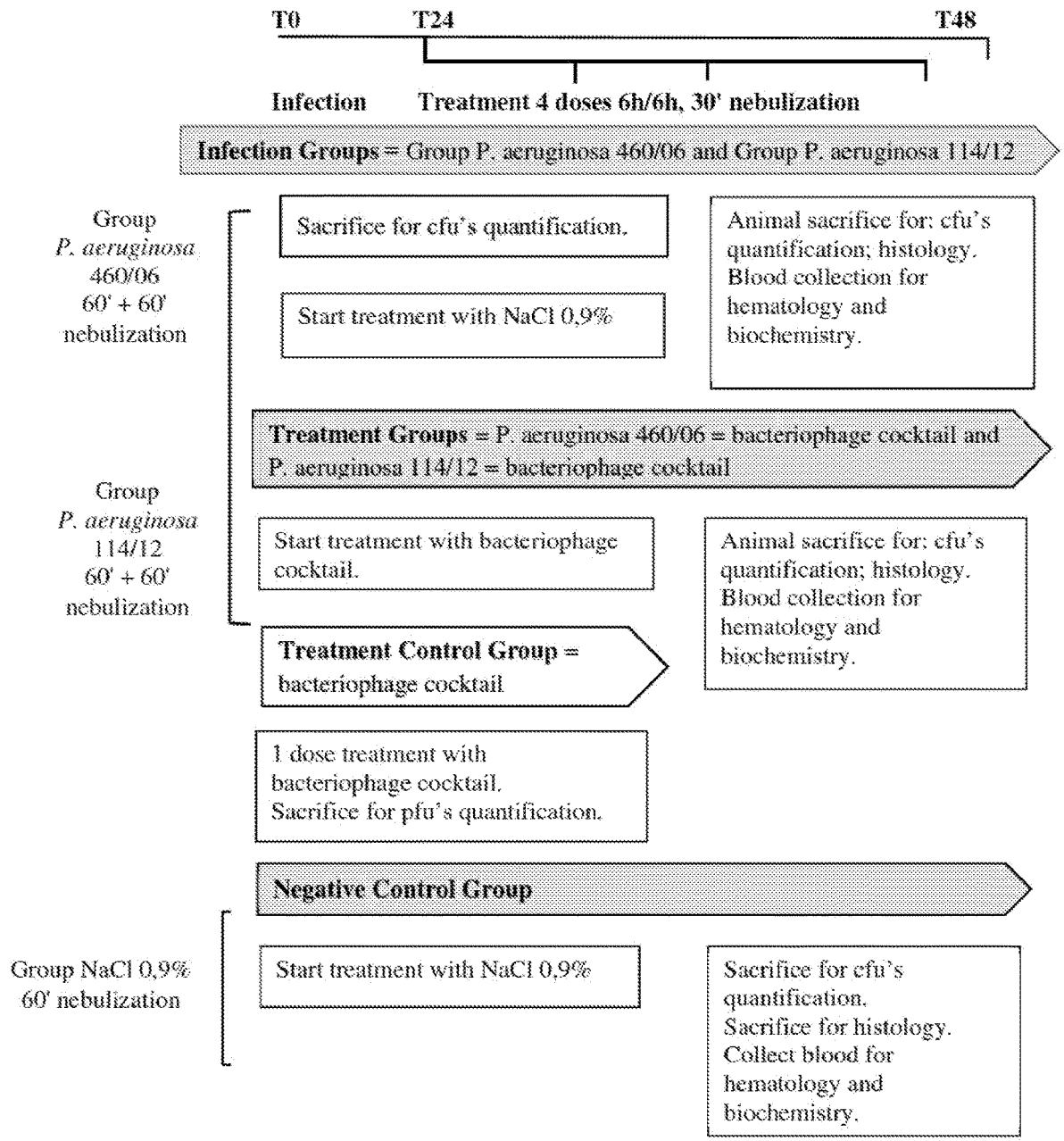
FIG. 1 illustrates the study design for using a mice model of treating acute lung infection with bacteriophage of the present invention.
Figure 2:
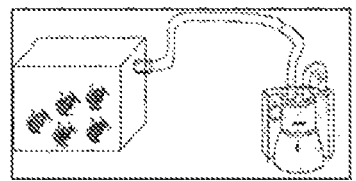
FIG. 2 illustrates a nebulization system for use inside a class II biological safety cabinet for aerosol administration of bacteriophage compositions of the present invention.

FIG. 2 illustrates a nebulization system used inside a class II biological safety cabinet. The nebuliser equipment used during the course of the animal's experiments was the AIRPROJECT PIC solution (Artsana S.p.a., Grandate, Italy) an ultrasonic aerosol with the following operating specifications; drug maximum capacity, 6.5 mL; frequency, 2.5 MHz; particle size, 3.6 μm±0.15 mass median aerodynamic diameter (MMAD) and breathable fraction of 71%. The AIRPROJECT PIC was connected to an inhalation chamber were the animals (5 animal's maximum) were subject to the bacterial suspensions during infections and the bacteriophage cocktail during treatment with a mean nebulization time of 10 minutes.

Animals

Ten week-old Specific Pathogen Free female CD1 mice, weighing 30-35 g, were obtained from Charles River Laboratories (L'Arbresle Cedex, France). The animals were hosted in an approved animal care center under the following conditions: housing in micro-isolators in a room with controlled humidity (50-70%) and temperature (20-22° C.), a 12-hour light and 12-hour dark cycle, and free access to pelleted rodent chow and filter-sterilized water. The animals were initially housed in groups of 5. After infection, they were housed according to their experimental groups. All surgical procedures were performed in a class II biological safety cabinet using autoclave-sterilized instruments. In this study a total of 33 mice were rendered transiently neutropenic with 150 mg/kg body weight cyclophosphamide given intraperitoneally (i.p.) 4 days prior to infection and with 100 mg/kg given i.p. 1 day before infection Infection Twenty-nine mice were infected with *Pseudomonas aeruginosa* 1992/05 by the inhalation of aerosols. Six ml of *P. aeruginosa* 1992/05 (approximately $1 \times 10^8$ cfu/ml) suspension was nebulized during 15 min. After 12 hours 2 animals were euthanized and the lungs collected for cfu quantification. The 27 infected animals were randomly divided into 3 experimental groups: *P. aeruginosa* 1992/05 Infection Group (n=9); Phage treatment group (n=9); Antibiotic treatment group (n=9). Negative control group included two animals nebulized with 6 ml of NaCl 0.9%.

Bacteriophage Treatment Protocol

Treatment with bacteriophage started 24 hours post-infection (p.i.). In order to evaluate the Multiplicity of Infection (MOI), 2 non-infected and one dose-treated animals were euthanized and lungs collected for pfu quantification (Treatment Control Group).

Mice of the Phage treatment group were nebulized with 6 ml of the bacteriophage cocktail (approximately $6.0 \times 10^8$ pfu/ml) during 15 minutes. The animals of the Antibiotic treatment group were treated with Colistin sulphate salt >15000 U/mg (Sigma, St. Louis, Mo., USA) by i.p injection of 16 mg/kg dose (Hengzhuang, 2012). The treatment protocol involved 4 doses, given at 6 hours intervals, followed by a 4 hour resting period, after which the animals were euthanized and lungs collected for microbiology and histopathology analysis. The animals of the *P. aeruginosa* Infection groups and Negative Control Group were nebulized with NaCl 0.9% on the same schedule.

In Vivo Evaluation

The test animals were evaluated during the experimental study. Score sheets were used to assess the health status of each animal, at predetermined intervals (24 and 48 hours post-infection). A score of 0 to 3 (normal to severe) was assigned, according to direct observation of the animal's coat, activity, breathing, and movement, and the score served to provide a summary of the welfare of each mouse.

Euthanization and Lung Collection

In a class II biological safety cabinet, animals were euthanized by isoflurane (Isoflo, Esteve veterinaria, Barcelona, Spain) inhalation in a home-made small capacity closed chamber. Before beginning dissection, the animal was confirmed to be dead, by checking for the absence of any respiratory movements or heartbeat. Then the surgical site was washed with 70% ethanol. With clean and sterile surgical instruments, tweezers and scissors, a small incision was made just below the rib cage, cutting through skin and connective tissue across the mouse. Lateral incisions were made on each side up to the neck of the mouse. The rib cage was separated by forceps to expose the organs and the lungs; and then dissected out by gently tugging on the trachea while snipping away the connective tissue, leaving the lungs intact. The entire lung was collected and placed in a 15 ml centrifuge tube until use. The instruments were disinfected between use in different animals by removing any blood and debris, dipping in a hot glass bead sterilizer for approximately 30 seconds, allowing complete cooling, and then rinsing with 70% ethanol. The collected lung tissue of each mouse was weighed and homogenized in 2 ml NaCl 0.9%.

At 34 hours post-infection and 22 hours after beginning of the treatment, 6 animals from the 6 mice from Infection Group, Phage treatment group, Antibiotic treatment group and one mouse from the Negative control group were euthanized and lungs collected for cfu quantification. The lungs of also 3 mice from the Infection Group, Phage treatment group and Antibiotic treatment group, and 1 from the Negative control group were collected for histopathology analysis.

Microbiological Analysis

The homogenized lung tissue was vortexed for 5 seconds, and a 100 μl aliquot of the suspension was used for serial dilutions. Viable bacterial cells were counted using the 10-fold serial dilution method (Murray P R, 2003, *Manual of clinical microbiology*. Washington, D.C.: ASM Press). From each dilution, 100 μl were inoculated onto plates of cetrimide agar selective media (Biokar Diagnostics, Pantin Cedex, France). The plates were incubated under aerobic conditions at +37° C. for 24 hours, after which colony counts were performed. Colonies grown on cetrimide agar were presumptively identified as *Pseudomonas aeruginosa* based on their morphology (Brown V I, et al., 1965, *J Clin Pathol* 18:752-756).

Histopathogical Analysis

For histopathogical analysis, the animals were euthanized as described above in a class II biological safety cabinet. Before beginning dissection, the animal was confirmed to be dead, by checking for the absence of any respiratory movements or heartbeat. Then the surgical site was washed with 70% ethanol. With clean and sterile surgical instruments, tweezers and scissors, a small incision was made just below the rib cage, cutting through skin and connective tissue across the mouse. Lateral incisions were made on each side up to the neck of the mouse. After separating the rib cage using forceps, the rest of the rib cage and other tissue were carefully removed to expose the trachea, aiming to the remove as much bone as possible. The forceps were placed under the trachea to keep it exposed, making sure the trachea was separated from the esophagus, and formaldehyde, 4% phosphate buffer (Applichem, Darmstadt, Germany), was injected into the trachea (between the cartilage rings) until the lungs inflated. The lungs were dissected out by gently tugging on the trachea while snipping away the connective tissue. The entire lung was collected into a 15 ml centrifuge tube with approximately 10 ml of formaldehyde, 4% phosphate buffer, and kept at room temperature, with agitation, for 24 hour fixation. Afterwards, the formaldehyde, 4% phosphate buffer was substituted with 70% ethanol.

Histology analysis was performed by the Histology Service at IMM. The tissue was embedded in paraffin and longitudinally sectioned in 3-μm increments. This allowed the anatomy of the lung to be clearly visible, making it possible to see the large airways branching into smaller airways, and finally opening into the alveolar ducts and space. For each lung, two serial sections were placed on 2 slides and stained with hematoxylin-eosin (HE) and Gram. The tissue slides were examined under light microscopy and the sections were photographed using a motorized inverted bright-field microscope (Zeiss Axiovert 200M, Göttingen, Germany) equipped with a color camera (Leica DM2500, Leica Microsystems GmbH, Wetzlar, Germany) at 50× magnification.

Second Rodent Model—Chronic Wound Infection

A rat experimental model of chronic wound infection was optimized for *Pseudomonas aeruginosa* infection. The model was based in that described by Mendes et al in 2012 without the induction of diabetes. A bacteriophage cocktail composed with *P. aeruginosa* F99/10, F27/12 and Psa_F95/13 bacteriophages was administered directly to the wounds for the treatment of the established infection.

Animals

Specific pathogen free male Wistar rats, weighing 175-200 g (8 weeks old) were obtained from Charles River Laboratories (L'Arbresle Cedex, France). The animals were hosted in an approved animal care center under the following conditions: housing in micro-isolators in a room with controlled humidity (50-70%) and temperature (20-22° C.), a 12-hour light and 12-hour dark cycle, and free access to pelleted rodent chow and filter-sterilized water. The animals were initially housed in groups of 3. After ulceration and infection, they were housed individually according with the experimental groups. All surgical procedures were performed in a class II biological safety cabinet using autoclave-sterilized instruments. A total of 15 rats were used in this study.

Infection

Twelve rats were subject to shaving and ulceration (Mendes et al 2013) before infection with *Pseudomonas aeruginosa* 1992/05. A bacterial suspension was prepared in NaCl 0.9% and adjusted to McFarland's scale 0.5 to a final concentration of $1.5 \times 10^8$ cfu/mL from where 100 μl was used to inoculate the wounds. Wounds of three animals from the Negative control group were inoculated with 100 μl was NaCl 0.9%. After 4 days the infected animals were randomly divided into 2 experimental groups: *P. aeruginosa* 1992/05 Infection Group (n=6); Phage treatment group (n=6). On days 4, 5, and 7 post-wounding, the semi-occlusive dressing was cut off, and the wounds were debrided. Swabs were collected for cfu determination.

Bacteriophage Treatment Protocol

The phage treatment protocols started 4 days' post-infection (p.i.). All test groups underwent a bacteriophage treatment protocol that consisted of an induction phase and a maintenance phase. The induction phase occurred after the first debridement (postwounding day 4) and comprised of five 100 μL primary bacteriophage cocktail administrations (every 4 hours). The maintenance phase was from day 5 to day 8 and consisted of twice-daily (every 12 hours) 100 μL primary bacteriophage cocktail administrations. If debridement was performed, bacteriophage administration followed. The control groups received 100 μL sterile saline with the same frequency. Bacteriophage cocktail with approximately $2 \times 10^{11}$ pfu/ml.

Animal Euthanize and Wound Collection

Prior to sacrifice on postwounding day 7, wounds were photographed from a standard 1.5-cm distance using a mounted digital microscope. All animals were sacrificed by overdose of isoflurane on day 7 postwounding, and each ulcer and the surrounding 0.5-cm skin border was harvested with sterile surgical scissors and placed in a tube.

Microbiological Analysis

On days 4, 5, and 7 postwounding and after debridement, a liquid Amies elution swab (eSwab Collection and Preservation System, Copan, Corona, Calif.) was used to collect and transport swab cultures. Bacteria collection was performed using the one-point method described by Sullivan et al. Briefly, a sterile swab was used to scrub the center surface of each wound by rotating the swab three times clockwise with enough manual pressure to produce a small amount of exudate. The swab was then inserted into the tube and transported to the laboratory for immediate processing. The swab collection tube was vortexed (with the swab inside) for 5 seconds, and a 100 µL aliquot of the resulting suspension was used for serial dilutions. Quantification was performed using the 10-fold serial dilution method (Murray P R, Baron E J, Jorgensen J H, Pfaller M A, Yolken R H. 2003. Manual of clinical microbiology. Washington, D.C.: ASM Press). From each dilution 100 µL were inoculated onto plates of cetrimide agar (Biokar Diagnostics, Pantin Cedex, France) selective media. The plates were incubated under aerobic conditions at +37° C. for 24 hours, after which colony counts were performed. Colonies grown on cetrimide agar were presumptively identified as *Pseudomonas aeruginosa* based on their morphology (Brown V I, Lowbury E J. 1965. Use of improved cetrimide agar medium and other culture methods for *Pseudomonas aeruginosa*. J Clin Pathol 18:752-756).

Histopathogical Analysis

For histopathogical analysis the animals were euthanized as described above in the class II biological safety cabinet, of the animal facility. The collected samples were fixed in 10% buffered formalin solution, and after overnight fixation, they were trimmed and cut through at the widest margin, embedded in paraffin, and sectioned in 3-mm increments. Sections were made perpendicular to the anterior-posterior axis and perpendicular to the wound surface. For each wound, two serial sections were placed on a slide and stained with hematoxylin & eosin. The sections were photographed using a motorized inverted bright-field microscope (Zeiss Axiovert 200M, Göttingen, Germany) equipped with a color camera (Leica DM2500, Leica Microsystems GmbH, Wetzlar, Germany) at 50× magnification. Each image was analyzed for epithelial gap (EG) and dermal gap (DG) as described in (Brown V I, Lowbury E J. 1965. Use of improved cetrimide agar medium and other culture methods for *Pseudomonas aeruginosa*. J Clin Pathol 18:752-756).

Hematology and Biochemistry Analysis

Blood samples were collected by cardiac puncture from 5 animals (1 from the *P. aeruginosa* 460/06 Infection group; 1 from the *P. aeruginosa* 114/12 Infection group; 1 from the *P. aeruginosa* 460/06 Treatment group; 1 from the *P. aeruginosa* 114/12 Treatment group; and 1 from the negative control group) for hematology and biochemistry analysis. Whole blood samples of each animal were divided into 2 microtubes (about 50 µl for hematology analysis and about 100 µl for biochemistry analysis).

Whole blood samples were analyzed in the Poch-100iv Diff hematological analyzer (Sysmex Corporation, Kobe, Japan) for: WBC (white blood cell count), (RBC) red blood cell count, HGB (hemoglobin), HCT (hematocrit), PLT (platelet count). Blood samples for biochemistry were refrigerated overnight at 4° C. to ensure complete clotting. The clotted blood was centrifuged at 13,200 rpm for 5 minutes to separate the serum from the debris and clotted cells. The serum was transferred to a new microtube and stored at −20° C. until needed. With the comprehensive diagnostic profile of the VetScan (Abaxis, Calif., USA), which provides chemistry and electrolyte analysis for general health, the serum was analyzed for: ALB (albumin), ALP (alkaline phosphatase), ALT (alanine aminotransferase), AMY (amylase), BUN (blood urea nitrogen), CA (calcium), CRE (creatinine), GLOB (globulin), GLU (glucose), K+ (potassium), Na+ (sodium), PHOS (phosphorus), TBIL (total bilirubin), and TP (total protein).

Statistical Analysis

All quantitative microbiological results from the in vivo experiments are presented as means, with the respective standard deviation, and expressed as logarithm-transformed values, log (cfu/g) for lung tissue samples. Comparisons between groups were performed using two-tailed Mann Whitney test, and a p value <0.05 was considered significant. All data was entered into a spreadsheet program (Excel, Microsoft, Redmond, Wash.) for statistical analysis. Analytical statistics were performed using GraphPad Prism version 5.04 for Windows, GraphPad Software, San Diego Calif. USA, www.graphpad.com.

Results from In Vitro Experiments

Transductions Assays

Figure 20:
FIG. 20 illustrates the agarose gel electrophoresis of 16s rRNA gene PCR-amplified region (8 to 1525 bp) from DNAs extracted from phage F99/10 and F27/12 lysates.
Figure 21:
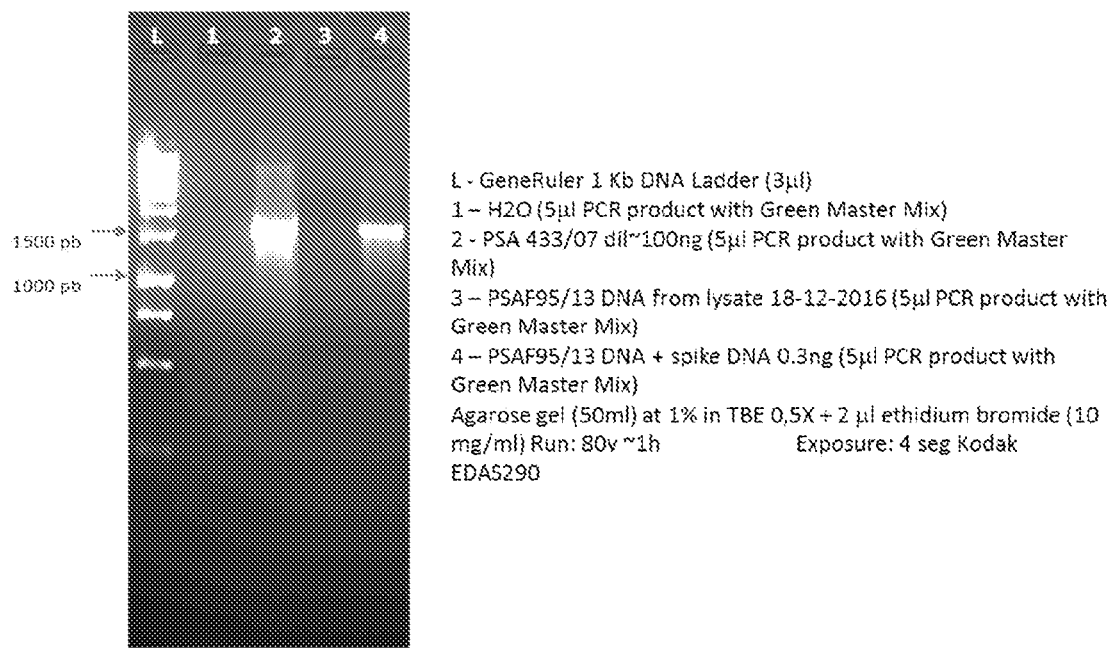
FIG. 21 illustrates the agarose gel electrophoresis of 16s rRNA gene PCR-amplified region (8 to 1525 bp) from DNAs extracted from phage Psa_F95/13 lysate.

The capability of a bacteriophage of performing generalized transduction was analyzed by the amplification of the 16s rRNA gene in lysates of the phages. DNA extracted from the respective hosts was used as positive control in the PCR. Additionally, each sample of phage DNA was also amplified in the presence of spike DNA (0.5 ng of host DNA) that served as a reaction control. FIGS. 20 and 21 shown the amplification of the 16s rRNA gene in DNAs from the host and phages F99/10, F27/12 and Psa_F95/13.

Analysis of Bacteriophage Host Range in *P. aeruginosa* Isolates

Infection efficacy of the selected *P. aeruginosa* bacteriophages was assayed by testing the phage against a panel of clinical isolates. Specifically, susceptibility of 100 strains (52 with distinct molecular profiles of which 10 from different ST profiles) was tested using each bacteriophage and results are presented in Tables 1-5 below. In each case, serial dilutions of the bacteriophage suspension (prepared from a CsCl purified lysate) were prepared. Three dilutions were plated, where the dilutions have titers that originate isolated phage plaques. Sensitivity of each strain to the bacteriophage was evaluated using a scale indicating a transparent plate (++++) to countable phage plaques (+). Resistance to phage infection is indicated as (−). The percent of strains that can be infected also is indicated.

Table 1 illustrates the host-range of F99/10, determined by plaque assay in 100 *P. aeruginosa* (PSA) strains isolated from respiratory clinical samples.

TABLE 1

| Phage | Titer (pfu/ml) | Phage sensitivity (%) of PSA strains (n = 100) | | | | | Total of infected strains (%) |
|---|---|---|---|---|---|---|---|
| | | ++++ | +++ | ++ | + | − | |
| F99/10 | 2.00E+04 | 16 | 5 | 7 | 2 | 70 | 30 |
| | 2.00E+03 | 2 | 13 | 9 | 6 | 70 | 30 |
| | 2.00E+02 | 0 | 2 | 8 | 18 | 72 | 28 |

Table 2 illustrates the host-range of F110/12, determined by plaque assay in 100 P. aeruginosa (PSA) strains isolated from respiratory clinical samples.

TABLE 2

| Phage | Titer (pfu/ml) | Phage sensitivity (%) of PSA strains (n = 100) | | | | | Total of infected strains (%) |
|---|---|---|---|---|---|---|---|
| | | ++++ | +++ | ++ | + | − | |
| F110/10 | 1.49E+04 | 0 | 5 | 9 | 5 | 81 | 19 |
| | 1.49E+03 | 0 | 0 | 3 | 15 | 82 | 18 |
| | 1.49E+02 | 0 | 0 | 0 | 15 | 85 | 15 |

Table 3 illustrates the host-range of F27/12, determined by plaque assay in 100 P. aeruginosa (PSA) strains isolated from respiratory clinical samples.

TABLE 3

| Phage | Titer (pfu/ml) | Phage sensitivity (%) of PSA strains (n = 100) | | | | | Total of infected strains (%) |
|---|---|---|---|---|---|---|---|
| | | ++++ | +++ | ++ | + | − | |
| F27/12 | 1.20E+04 | 0 | 1 | 6 | 13 | 80 | 20 |
| | 1.20E+03 | 0 | 0 | 2 | 17 | 81 | 19 |
| | 1.20E+02 | 0 | 0 | 0 | 14 | 86 | 14 |

Table 4 illustrates the host-range of Psa_F83/13, determined by plaque assay in 100 P. aeruginosa (PSA) strains isolated from respiratory clinical samples.

TABLE 4

| Phage | Titer (pfu/ml) | Phage sensitivity (%) of PSA strains (n = 100) | | | | | Total of infected strains (%) |
|---|---|---|---|---|---|---|---|
| | | ++++ | +++ | ++ | + | − | |
| Psa_F83/13 | 2.00E+04 | 1 | 0 | 9 | 7 | 83 | 17 |
| | 2.00E+03 | 0 | 1 | 0 | 16 | 83 | 17 |
| | 2.00E+02 | 0 | 0 | 1 | 14 | 85 | 15 |

Table 5 illustrates the host-range of Psa_F95/13, determined by plaque assay in 100 P. aeruginosa (PSA) strains isolated from respiratory clinical samples.

TABLE 5

| Phage | Titer (pfu/ml) | Phage sensitivity (%) of PSA strains (n = 100) | | | | | Total of infected strains (%) |
|---|---|---|---|---|---|---|---|
| | | ++++ | +++ | ++ | + | − | |
| Psa_F95/13 | 2.00E+04 | 1 | 3 | 3 | 8 | 85 | 15 |
| | 2.00E+03 | 1 | 0 | 4 | 6 | 89 | 11 |
| | 2.00E+02 | 0 | 1 | 1 | 5 | 93 | 7 |

Table 6 combines the results from the 5 bacteriophages of Tables 1, 3 and 5, showing percentage of infected P. aeruginosa, using the phages individually and in combination. Table 6 illustrates that the combination increases the percent of strains infected, giving a P. aeruginosa host-range of 44%.

TABLE 6

| Phages | Titer (pfu/ml) | Title of infected strains (%) | |
|---|---|---|---|
| | | Individual | Combined |
| F99/10 | 2.00E+04 | 30 | 42% |
| F27/12 | 1.20E+04 | 20 | |
| PsaF95/13 | 2.60E+04 | 15 | |

In addition, when the results for these bacteriophages from only the 52 molecularly diverse P. aeruginosa isolates were considered, the combined percentage was the same. Moreover, it was observed that 19% of the strains were infected by just one of the bacteriophages and 15% were susceptible to at least 3. None of the strains was infected by all 5 of the bacteriophages.

Analysis of Bacteriophage Host Range in K. pneumoniae Isolates

Infection efficacy of the selected K. pneumonia bacteriophages also was assayed by testing the phages against a panel of clinical isolates. Specifically, susceptibility of 103 clinical strains was tested using each bacteriophage and results are presented in Tables 7-11 below. Of the 103 clinical strains used, 73 were characterized by their capsular serotype, a feature that directly influences the ability of a bacteriophage to infect the bacteria. In each case, serial dilutions of the bacteriophage suspension (MSP lysate) were prepared. Three dilutions were plated, where the dilutions have titers that originate isolated phage plaques. Sensitivity of each strain to the bacteriophage was evaluated using a scale indicating a transparent plate (++++) to countable phage plaques (+). Resistance to phage infection is indicated as (−). The percent of strains that can be infected also is indicated.

Table 7 illustrates the host-range of F391/08, determined by plaque assay in 103 K. pneumonia (KLE) strains isolated from clinical samples (30 respiratory clinical samples, and 73 diverse clinical samples).

TABLE 7

| Phage | Titer (pfu/ml) | Phage sensitivity (%) of KLE strains (n = 103) | | | | | Total of infected strains (%) |
|---|---|---|---|---|---|---|---|
| | | ++++ | +++ | ++ | + | − | |
| F391/08 | 2.00E+06 | 11 | 3 | 1 | 2 | 86 | 17 |
| | 2.00E+05 | 2 | 8 | 4 | 3 | 86 | 17 |

Table 8 illustrates the host-range of Kle_F92/15, determined by plaque assay in 103 K. pneumonia (KLE) strains isolated from clinical samples (30 respiratory clinical samples, and 73 diverse clinical samples).

TABLE 8

| Phage | Titer (pfu/ml) | Phage sensitivity (%) of KLE strains (n = 103) | | | | | Total of infected strains (%) |
|---|---|---|---|---|---|---|---|
| | | ++++ | +++ | ++ | + | − | |
| KleF92/15 | 3.90E+06 | 7 | 4 | 2 | 4 | 86 | 17 |
| | 3.90E+05 | 1 | 7 | 3 | 5 | 87 | 16 |

Table 9 illustrates the host-range of Kle_F105/15, determined by plaque assay in 103 K. pneumonia (KLE) strains isolated from clinical samples (30 respiratory clinical samples, and 73 diverse clinical samples).

TABLE 9

| Phage | Titer (pfu/ml) | Phage sensitivity (%) of KLE strains (n = 103) | | | | | Total of infected strains (%) |
|---|---|---|---|---|---|---|---|
| | | ++++ | +++ | ++ | + | − | |
| KleF105/15 | 1.65E+07 | 3 | 3 | 0 | 2 | 95 | 8 |
| | 1.65E+06 | 1 | 2 | 3 | 2 | 95 | 8 |

Table 10 illustrates the host-range of Kle_F134/15, determined by plaque assay in 103 *K. pneumonia* (KLE) strains isolated from clinical samples (30 respiratory clinical samples, and 73 diverse clinical samples).

TABLE 10

| Phage | Titer (pfu/ml) | Phage sensitivity (%) of KLE strains (n = 103) | | | | | Total of infected strains (%) |
|---|---|---|---|---|---|---|---|
| | | ++++ | +++ | ++ | + | − | |
| KleF134/15 | 6.30E+06 | 0 | 0 | 0 | 3 | 100 | 3 |
| | 6.30E+05 | 0 | 0 | 0 | 3 | 100 | 3 |

Table 11 illustrates the host-range of Kle_F141/15, determined by plaque assay in 103 *K. pneumonia* (KLE) strains isolated from clinical samples (30 respiratory clinical samples, and 73 diverse clinical samples).

TABLE 11

| Phage | Titer (pfu/ml) | Phage sensitivity (%) of KLE strains (n = 103) | | | | | Total of infected strains (%) |
|---|---|---|---|---|---|---|---|
| | | ++++ | +++ | ++ | + | − | |
| KleF141/15 | 5.38E+07 | 0 | 0 | 1 | 1 | 101 | 2 |
| | 5.38E+06 | 0 | 0 | 0 | 2 | 101 | 2 |

The highest % of infection was obtained using F391/08 and Kle_F92/15, each exhibiting 17% infection. Kle_F105/15, Kle_F134/15, and Kle_F141/15 exhibited the following % of infection, respectively: 8%, 3%, and 2%.

Table 12 combines the results from the 5 bacteriophages of Tables 7-11, showing percent of infected *K. pneumonia*, using the phage individually and in combination. Table 12 illustrates that the combination increases the percent of strains infected, giving a *K. pneumonia* host-range of 32%.

TABLE 12

| Phages | Titer (pfu/ml) | Title of infected strains (%) | |
|---|---|---|---|
| | | Individual | Combined |
| F391/08 | 2.00E+06 | 17 | 32% |
| KleF92/15 | 3.90E+06 | 17 | |
| KleF105/15 | 1.65E+07 | 8 | |
| KleF134/15 | 6.30E+06 | 3 | |
| KleF141/15 | 5.38E+07 | 2 | |

Table 13 analyzes bacteriophage infection in relation to the capsular serotypes of the bacteria tested for host-range, showing the number of *K. pneumonia* strains of a certain capsular serotype that can be infected by each of the individual *K. pneumonia* phage.

TABLE 13

| Capsular serotype | Number of tested strains | Phages | | | | |
|---|---|---|---|---|---|---|
| | | KleF391/08 | KleF92/15 | KleF105/15 | KleF134/15 | KleF141/15 |
| K2 | 15 | 4 | 1 | 1 | | |
| K3 | 8 | 3 | 1 | | | |
| K8 | 5 | | 1 | | | |
| K15 | 8 | | | | | |
| K16 | 1 | | | | | |
| K19 | 1 | | | | | |
| K20 | 1 | | | | | |
| K21 | 1 | | | | | |
| K24 | 3 | | 1 | 1 | | |
| K26 | 1 | 1 | | | | |
| K28 | 1 | | | | | |
| K30 | 1 | | 1 | | | |
| K35 | 1 | | | | | |
| K44 | 1 | | | | | |
| K55 | 4 | 2 | 3 | | | |
| K68 | 3 | 1 | 1 | 1 | | |
| K8, 47 | 1 | 1 | 1 | | | |
| K6, 68 | 1 | 1 | 1 | 1 | | |
| K8, 35, 55 | 1 | | | | | |
| O:1 | 12 | 1 | | 1 | | 1 |
| O:5 | 1 | 1 | 1 | | | |
| Neg | 2 | 1 | 2 | 1 | | |

As seen in Table 13, all bacteriophages that infected K68 strains (Kle_F105/15, Kle_F92/15, and F391/08) also infected the K6,68 strain. Only one of the bacteriophages that infected the K8,47 strain also infected K8 strains (Kle_F92/15). F391/08 infected more strains from the same serotype. Kle_F141/15 infected only one strain and it was a non-capsulated strain. Kle_F134/15 was the only bacteriophage that did not infect any of the tested strains with the characterized capsular serotype. None of the 8 K8 strains become infected, and neither did any of the K16, K19, K20, K21, K35, K44, and K8,35,55 strains. Importantly, however, the bacteriophage of the invention were not restricted to any individual capsular serotypes but showed a range over multiple serotypes.

Results of Genomic Analysis

Whole-genome sequencing of *P. aeruginosa* F99/10, F27/12, and Psa_F95/13; and *K. pneumoniae* F391/08, Kle_F92/15, Kle_F105/15, Kle_F134/15, and Kle_F141/15 genomic DNA was carried out using pyrosequencing. The complete genome sequences of F99/10 and F27/12 bacteriophages included in the cocktail were determined by pyro sequencing using the Genome Sequencer FLX Titanium and the assembly of quality filtered reads was performed using GS De Novo Assembler all by Macrogen, Seoul, South Korea. The genome of Psa_F95/13 was sequenced using Illumina HiSeq2000 genome analyzer at BaseClear, Leiden, Netherlands.

DNA homology searches were carried out using BLASTN program (Zhang, Z, et al., 2000, *J Comput Biol* 7:203-214) on NCBI nucleotide collection databases. Upon annotation, a circular map for each of the genomes was prepared, indicating predicted orfs encoding proteins, as well as their putative functions. Results are shown in FIG. 3, FIG. 4, FIG. 5, FIG. 6, FIG. 7 and FIG. 8 for each of *P. aeruginosa* F99/10, F27/12 and F95/13; and *K. pneumoniae* F391/08, F92/15 and F105/15, respectively.

FIG. 3 illustrates the schematic organization of the F99/10 genome. The orfs predicted in the about 93 kb genome are represented by arrows and numbered in black, where arrow direction indicates the direction of transcription.

Based on initial NCBI nucleotide blast analysis (blastn), it was seen that phage F99/10 DNA (having a genome size of 92,792 bp) has that 96% similarity to that of *Pseudomonas* phage vB_PaeM_C2-10_Ab02 (NCBI Reference Sequence: LN610572.1), sharing up to 97% sequence identity in 96% of its genome compared with phage vB_PaeM_C2-10_Ab02. One hundred and eighty orfs were predicted and 28% were assigned a putative function.

FIG. 4 illustrates the schematic organization of the F27/12 genome. The orfs predicted in the about 86 kb genome are represented by arrows and numbered in black, where arrow direction indicates the direction of transcription.

For F27/12, analysis revealed that the most related genome sequences corresponded to *P. aeruginosa* bacteriophages DL52 (NCBI Reference Sequence: KR054028.1) and vB_PaeM_C1-14_Ab28 (NCBI Reference Sequence: LN610589.1). DNA homology searches indicated that 100% of phage F27/12 DNA (having a genome size of 65,855 bp) is highly similar to that of DL52, with identities up to 97% in 100% of its genome compared with DL52. Ninety orfs were predicted and putative functions were assigned in 28% of these.

FIG. 5 illustrates the schematic organization of the F95/13 genome. The orfs predicted in the about 43 kb genome are represented by arrows and numbered in black, where arrow direction indicates the direction of transcription.

For F95/13, analysis revealed that ~97% of the phage PsaF95/13 DNA is highly similar to that of *Pseudomonas* phage vB_pae_PS9N (NCBI Reference Sequence: AB910393.1). The sequence identity was up to 99% in 97% of genome sequence. Fifty-seven ORFs were predicted with 42% putative function assigned. Less than 1% of the predicted ORFs had no significant homology with any sequence from the NCBI non-redundant protein sequence database. No significant similarity with known virulence or toxin proteins or with elements typically associated with lysogeny (integrases, repressors, and anti-repressors) could be found in the sequences of these bacteriophages.

For the *K. pneumoniae* bacteriophages, the genomes were analyzed similarly. Whole-genome sequencing of *K. pneumoniae* F391/08, Kle_F92/15 and Kle_F105/15 bacteriophages genomic DNA was carried out. An initial NCBI nucleotide blast analysis (blastn) of the complete genome sequence of the selected bacteriophages was performed. The *K. pneumoniae* bacteriophage F391/08 revealed no significant homologies other bacteriophages than small portions of the genome. The highest similarity was observed for *E. coli* bacteriophage vB_EcoS_FFH1 (NCBI Reference Sequence: KJ190157.1). Kle_F92/15 bacteriophage (attached file of FASTA sequence) showed the highest similarity with bacteriophage *Salmonella* phage Stitch (*NCBI Reference Sequence*: KM236244.1). The bacteriophage Kle_F105/15 genomic sequence presented high homologies with other sequences from the NCBI database. The highest similarity was found for *Klebsiella* phage JD18 (NCBI Reference Sequence: KT239446.1). The bacteriophage F391/08 with a genome size of 113073 bp, shared up to 74% sequence identity in just 9% of genome coverage with *E. coli* bacteriophage vB_EcoS_FFH1. One hundred seventy-two ORFs were predicted with 39.5% putative function assigned. Thirty-six % of the predicted ORFs had no significant homology with any sequence from the NCBI non-redundant protein sequence database. Genome analysis of Kle_F92/15 bacteriophage revealed that the 111775 bp genome size, shared up to 98% sequence identity in 94% genome coverage of bacteriophage *Salmonella* phage Stitch. The 176 predicted ORFs presented putative function assigned in 47.2%. Only 5.7% of the predicted ORFs had no significant homology. Bacteriophages Kle_F105/15 with a 165326 bp genome presented high similarities with *Klebsiella* phage JD18. The sequence identity was up to 96% in 98% of genome sequence. Two hundred eighty-nine ORFs were predicted with 45.3% putative function assigned. Approximate fifty-four percent of the predicted ORFs had homology with sequences from the NCBI non-redundant protein sequence database however without function assigned.

Figure 6:
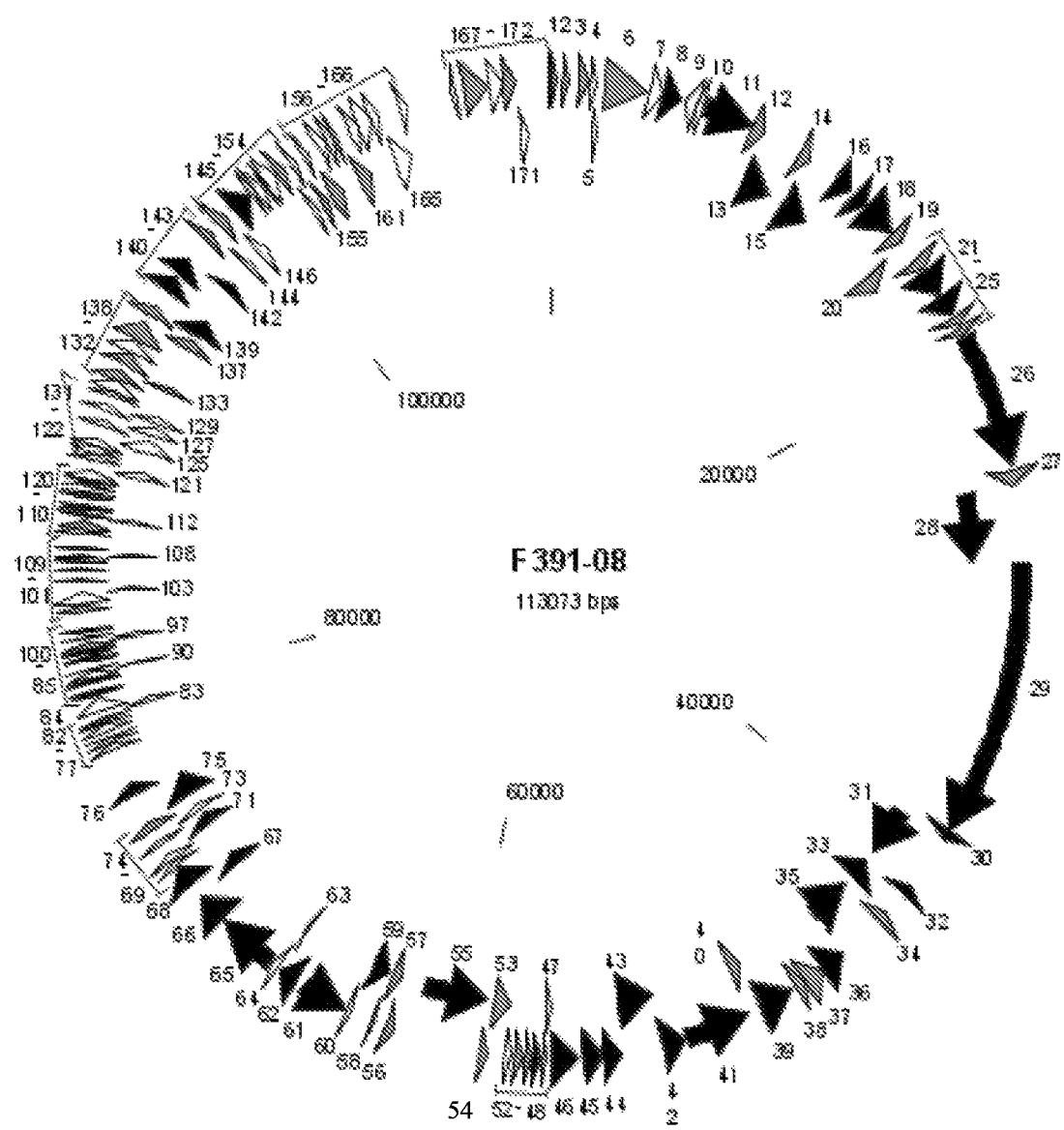
FIG. 6 illustrates the schematic organization of the F391/08 genome with functionally assigned orfs further listed on the right and on the bottom.

FIG. 6 illustrates the schematic organization of the F391/08 genome, which also is disclosed previously in PCT/PT2011/000031. The orfs predicted in the about 113 kb genome are represented by arrows and numbered in black, where arrow direction indicates the direction of transcription.

FIG. 7 illustrates the schematic organization of the Kle_F92/15 genome. The orfs predicted in the about 112 kb genome are represented by arrows and numbered in black, where arrow direction indicates the direction of transcription.

FIG. 8 illustrates the schematic organization of the Kle_F105/15 genome. The orfs predicted in the about 112 kb genome are represented by arrows and numbered in black, where arrow direction indicates the direction of transcription.

Results of Morphology

The purified bacteriophages were classified based on their virion morphology, using transmission electron microscopy. Morphological characteristics of F99/10, F27/12 and F95/13 are shown in representative images of FIG. 9 and morphological characteristics of F391/98, F 92/15 and F105/05 are shown in representative images of FIG. 10. The images show morphological features, including phage sizes, icosahedral heads, contractile tails, and tail fibers attached to the tip of the tails.

P. aeruginosa F99/10, F27/12 and F93/15 appeared to belong to the order Caudovirales. Phages F99/10 and F27/12 presented a contractile tail and an icosahedral head (capsid), with a baseplate structure and tail fibers, discernible at the tip of the tail. F95/13 presented a long noncontractile tail. These features, along with their genomic properties, classified these bacteriophages as members of the family Myoviridae and Siphoviridae respectively. Specifically, F99/10 showed a capsid size of 79.9±3.7 nm and a tail length of 131.9±3.0 nm; F27/12 showed a capsid size of 76.8±2.3 nm and a tail length of 141.1±3.3 nm; and F95/13 showed a capsid size of 51.9±2.5 nm and a tail length of 156±3.0 nm (FIG. 9).

K. pneumoniae F391/08, Kle_F92/15 and Kle_F105/15 bacteriophages appear to belong to the order Caudovirales. F391/08 and Kle_F92/15 bacteriophages presented icosahedral heads with long, non-contractile, thin tails, which are often flexible. These features, along with their genomic properties allowed us to classify these bacteriophages as members of the Siphoviridae family. Kle_F105/15 bacteriophage was classified as member of the family Myoviridae presenting a contractile tail and an icosahedral head (capsid), with a baseplate structure and tail fibers. Specifically, F391/08 showed a capsid size of 60.8±1.9 nm and a tail length of 223±10.9 nm; Kle_F92/15 showed a capsid size of 71.6±4.8 nm and a tail length of 170.0±22.1 nm; and Kle_F105/15 showed a capsid size of 102.1±2.9 nm and a tail length of 95.9±4.5 nm (FIG. 10).

Development of Phage Cocktail

To develop a bacteriophage cocktail for use in acute pulmonary infection, the bacteriophages F99/10, F27/12 and F93/15 were evaluated for lytic activity against planktonic cultures of P. aeruginosa 1992/05 strain. Conventional lysis curves were generated in controlled conditions, using a previously determined bacterial inoculum. A preliminary study was conducted to determine the mass load of P. aeruginosa bacteria that reaches the lungs in the murine model. Cfu determination indicated a bacteria load of approximately $2\times10^6$ cfu/g of lung and this was the inoculum used in the in vitro assays.

In determining the composition for a phage cocktail, each phage was tested in bacteria culture individually, as well as in combination with other phages, and at different MOIs. Viable bacteria were counted at 1-hour intervals for a 8-hour period and again at 24 hours, and counts were quantified using the 10-fold serial dilution method. Results are shown in FIG. 11 to FIG. 15.

Figure 11:
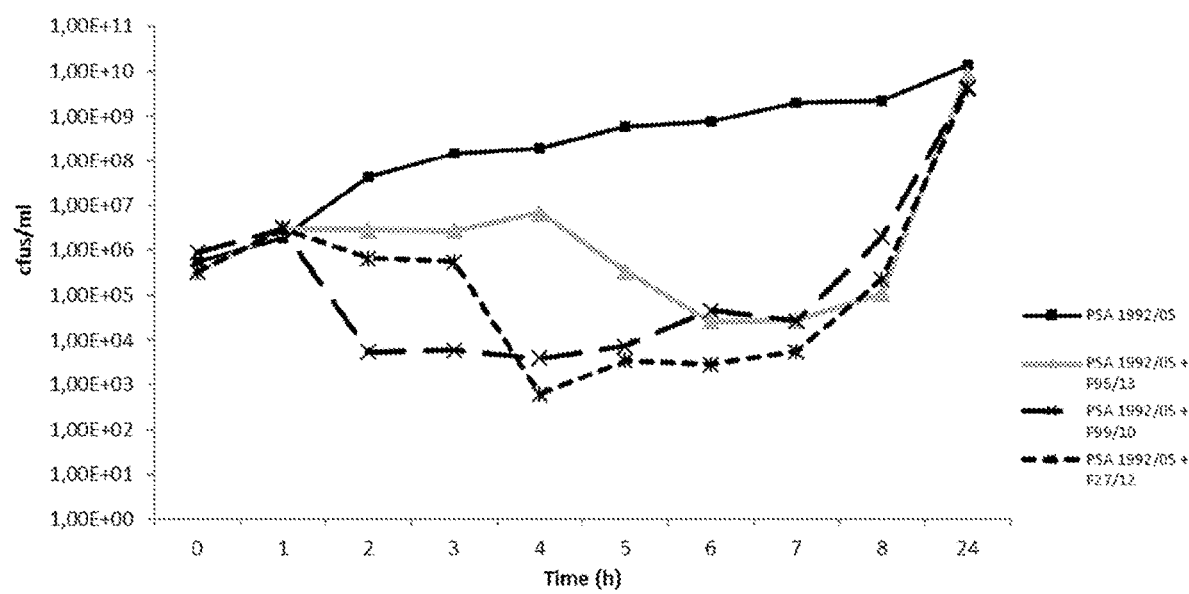
FIG. 11 illustrates individual lysis curves for *P. aeruginosa* F99/10, F27/12 and Psa_F95/13 phages using MOI's of 1.

FIG. 11 illustrates individual lysis curves for P. aeruginosa F99/10, F 27/12 and F95/13 bacteriophages using MOI's of 1. As FIG. 11 shows, phage F99/10's ability to infect P. aeruginosa 1992/05 was tested, individually, at MOI of 1. Within the first 4 hours, viable bacteria counts reduced by approximately 5 log units compared with the control culture of bacteria. After this time, bacterial counts began to increase and, at 8 hours post-infection, viable bacteria reached $2\times10^6$ cfu/ml. After 24 hours of incubation, viable counts were similar the control culture of bacteria. This represented 92% reduction compared with the control bacteria culture. The appearance of bacteria less susceptible to the phage may have prevented complete elimination of host cells by F99/10.

As FIG. 11 also shows, the ability of phage F27/12 to infect P. aeruginosa 1992/05 also was tested at a MOI of 1. In four hours, viable bacterial counts reduced approximately 6 log units compared to the control bacteria culture. After 8 hours of incubation, viable bacteria reached $2.5\times10^5$ cfu/ml. After 24 hours of incubation, viable bacteria reached $4.1\times10^9$ cfu/ml, similar to the control culture of bacteria.

As FIG. 11 also shows, the ability of phage F95/13 to infect P. aeruginosa 1992/15 tested at a MOI of 1. This bacteriophage was able to maintained stable the viable cells at approximate $3\times10^6$ cfu/mL, until the fourth hour of culture. Just at 6-hour incubation was observed a significant reduction in the viable counts of bacteria of approximately 4 log units when compared with the control culture of bacteria. Between 8 and 24 h of culture, viable bacteria count increased reaching at the end of the incubation period (24 h) $8.5\times10^9$ cfu/mL.

The increased number of viable cells at the end of the incubation period was observed for the 3 bacteriophages when assayed individually and probably was the result of the appearance of less susceptible bacteria to the bacteriophages infection.

The three bacteriophages presented a distinct behavior in P. aeruginosa 1992/05, shown by variations in the eight initial hours of incubation. Bacteriophage F99/10 was the first to reduce significantly the bacterial load, followed by F27/12. Psa_F95/13, in this host, tended to act further ahead in culture. This probably reflects differences in their life cycle in this particular host.

Figure 12:
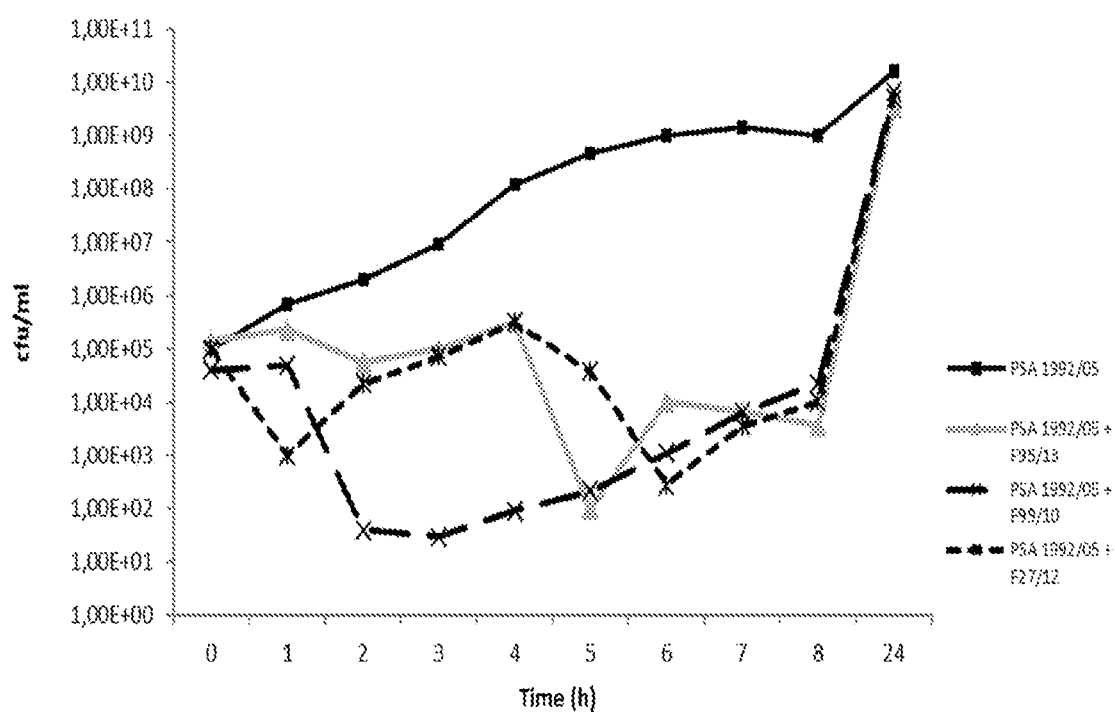
FIG. 12 illustrates individual lysis curves for *P. aeruginosa* F99/10, F27/12 and Psa_F95/13 phages using MOI's of 10.

FIG. 12 illustrates individual lysis curves for P. aeruginosa F99/10, F 27/12 and F95/13 bacteriophages using MOI's of 10. As FIG. 12 shows, the cultures with MOI approximate to 10 presented a similar trend as the culture with MOI equal to 1 for phages F99/10 and Psa_F95/13. F27/12 presented a different behavior with a higher MOI. However, all achieved a greater reduction in viable bacteria. For F99/10 the highest decrease in the viable cell count was observed at 3 h of incubation, with $3\times10^1$ cfu/mL, a 6 log reduction comparing with the bacteria control culture. At the end of the incubation period (24 h), viable bacteria were at $6.5\times10^9$ cfu/mL, a 60.6% reduction compared with the control culture. Bacteriophage F27/12 presented a significant decrease in bacterial counts at 1 h post phage inoculation but cells rapidly started to grow and the most pronounced decrease in cfu was observed at 6 h of culture reaching $2.8\times10^2$ cfu/mL. At the end of incubation viable counts were at $5\times10^9$ cfu/mL a similar reduction when compared with F99/10. Psa_F95/13 showed a similar behavior until 4 h of culture followed with a more pronounced reduction in cfu reaching $9\times10^1$ cfu/mL, a 7 log units' reduction comparing with control culture. At the end of the culture (24 h) the reduction in the bacterial counts were 80.6% comparing with control culture.

Figure 13:
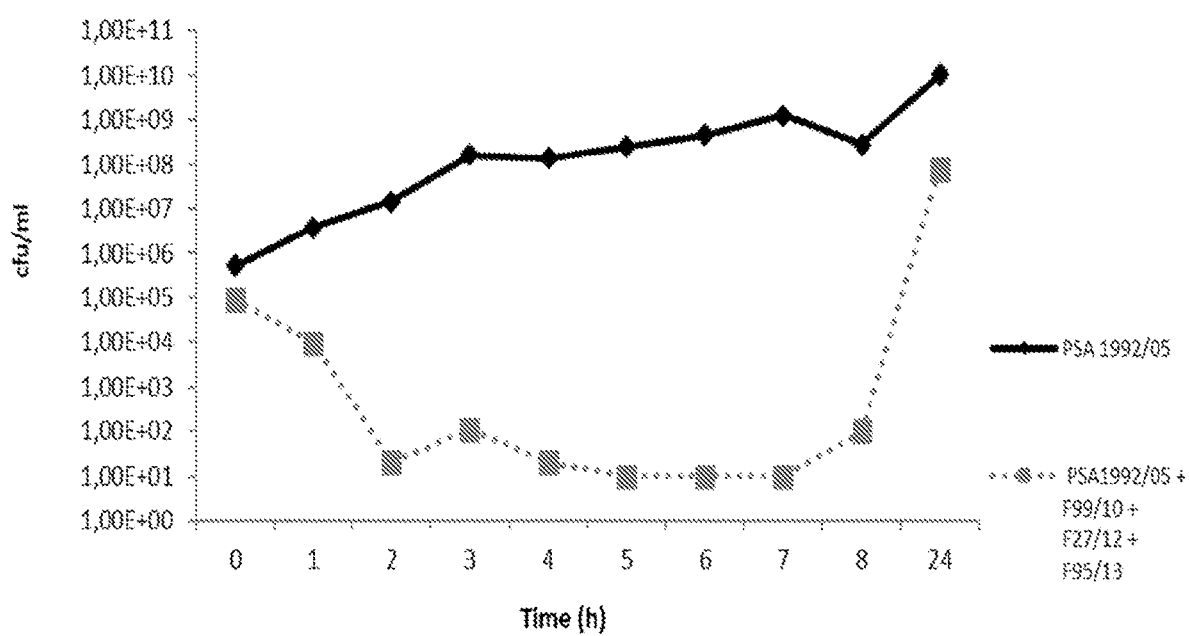
FIG. 13 illustrates combined lysis curves for *P. aeruginosa* F99/10, F27/12 and Psa_F95/13 phages using MOI's of 10.
Figure 14:
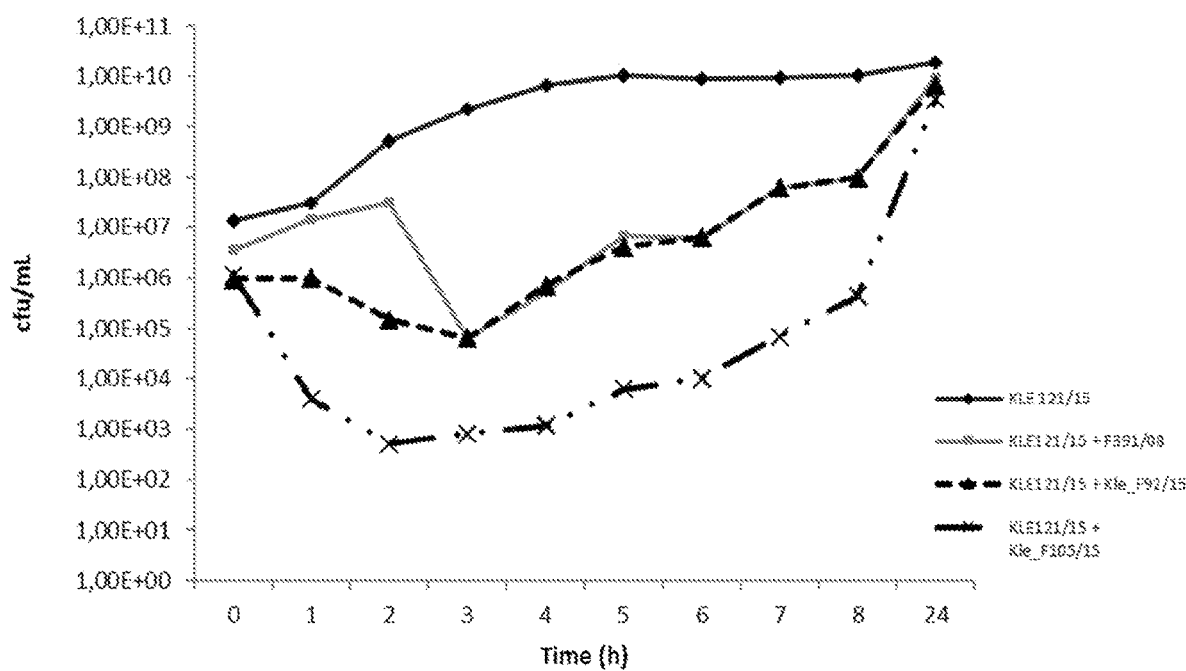
FIG. 14 illustrates single lysis curves of *K. pneumoniae* F391/08, Kle_F92/15 and Kle_F105/15 bacteriophages with MOI 10.
Figure 15:
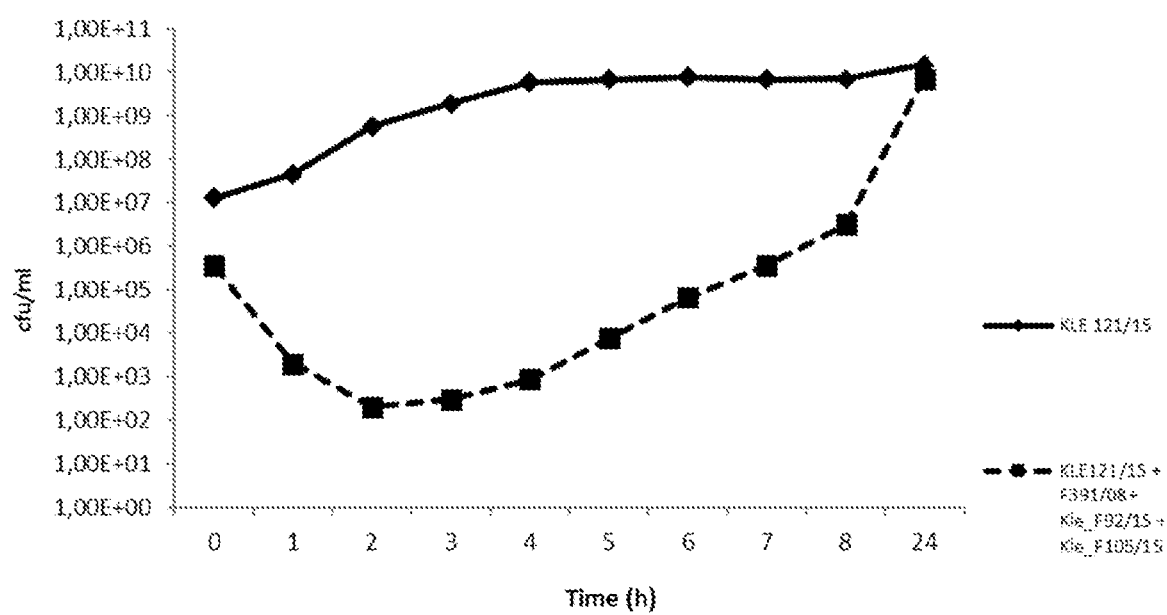
FIG. 15 illustrates combined lysis curves of *K. pneumoniae* F391/08, Kle_F92/15 and Kle_F105/15 bacteriophages with MOI 10.

As FIG. 13 shows, the lytic activity of the three combined bacteriophages with approximate MOI 10, was tested together in a final single bacteriophage cocktail, against PSA 1992/05. The bacteriophage cocktail was prepared in saline with each bacteriophage present at the predetermined MOI. Viable cell counts were quantified by the 10-fold serial dilution method and monitored at 1 h intervals for an 8 h period and again at 24 h.

Bacteriophages F99/10, F27/12 and Psa_F95/13 with MOI approximate to 10, were able to decrease significantly the bacteria counts for almost 6 hours of culture. The significant decrease was observed at 2 h post inoculation of the cocktail and until 8 h of culture the reduction reached 8 log units (at 6 h of culture the viable cells were at $1\times10^1$ cfu/mL). At the end of the incubation period (24 h) viable bacteria were at $8 \times 10^7$ cfu/mL. This represents a 99.2% reduction when comparing with the control culture of bacteria. This decrease observed in the cultures with the phage cocktail in comparison with the single cultures of the bacteriophages demonstrates the need of using more than one bacteriophage to increase the lytic activity against *Pseudomonas aeruginosa* strains and decrease the possibility of emergence of bacteria resistant to bacteriophages.

These results also demonstrate that the different bacteriophages can be mixed as a cocktail to broaden their properties, resulting in greater antibacterial spectrum (Loc-Carrillo C., et al, 2011, *Bacteriophage* 1(2): 111-114).

Rodent Model

Due to the virulent characteristics of *Pseudomonas aeruginosa* strains, the combined lytic activity of the *P. aeruginosa* bacteriophages F99/10, F27/12 and Psa_F95/13 was evaluated in vivo against *P. aeruginosa* 1992/05 strain. Two distinct infection models were established for this purpose.

Infection and Bacteriophage Treatment—Lung Infection Model

At 12 h post-infection and before the beginning of the treatment protocol, the bacteria load was determined in an attempted to calculate the actual MOI in the lungs. The mean value of the viable cell counts for the two animals infected with *P. aeruginosa* 1992/05 was $8.5 \times 10^5$ cfu/g of lung tissue. Two non-infected one dose-treated animals (Treatment Control Group) were also euthanized and lungs collected for pfu quantification. It was observed that the nebulization protocol delivered a mean value of $7.5 \times 10^4$ pfu/g into the lungs. Thereby taking into account the previous results was extrapolated that the MOI used in the first dose of treatment with the bacteriophage cocktail was, approximately, 0.1. This MOI was lower than what was planned. The cocktail used was posteriorly tittered and the concentration of each bacteriophages was much higher, average being $6.3 \times 10^8$ pfu/mL. Probably there was a great loss of phages along the tubes of the system and in the nebulization chamber.

Microbiology Analysis

At 34 h post-infection, 22 h after the beginning of the bacteriophage cocktail treatment, a total of 17 animals were euthanized. Four animals from Infection Group, six animals from the Phage treatment group, six animals from the Antibiotic treatment group and one from the Negative Control group were sacrificed and lungs collected for cfu determination. Two mice from the Infection Group were found dead at 30 h post-infection. The causes of death were unknown.

Figure 16:
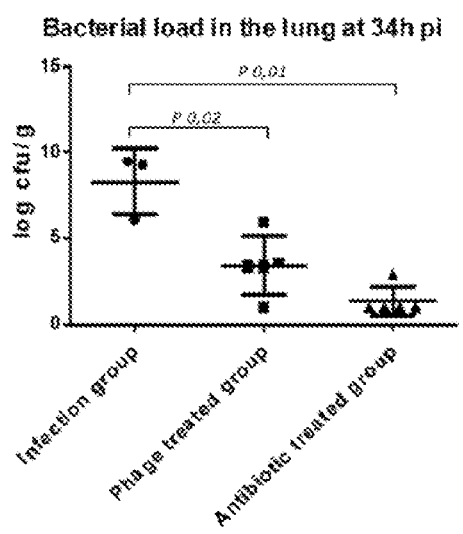
FIG. 16 illustrates efficacy of the bacteriophage cocktail of F99/10, F27/12 and Psa_F95/13 in vivo based on lung bacterial counts 34 hours post-infection, 22 hours post-treatment, for *P. aeruginosa* 1992/05 strain.

As FIG. 16 shows, colony counts of the lungs of 4 animals from the Infection Group were compared with those of the 6 animals from the Phage Treatment Group and Antibiotic Treatment Group. Infection Group colony counts were compared with those of the Phage Treatment Group. A decrease of ~3 log (a 99.87% reduction) was observed in the Phage Treatment Group. There was a statistically significant difference in colony count observed between the two groups (Infection $8.32 \pm 0.13$ log(cfu/g); Phage Treatment $3.44 \pm 1.36$ log(cfu/g); p value <0.05). The same analysis was done for the Infection Group and the Antibiotic Treatment Group. A decrease of ~7 log (almost 100% reduction) was observed in the Antibiotic Treatment Group (FIG. 12). There was a statistically significant difference in colony count observed between the two groups (Infection $8.32 \pm 0.13$ log(cfu/g); Antibiotic Treatment $3.25 \pm 0.86$ log(cfu/g); p value <0.05).

Histopathological Analysis

In the end of the experiment, 34 h post-infection, one mouse of Negative Control Group and three mice from the Infection, Phage Treatment and Antibiotic Treatment Group were euthanized and lungs collected for histopathological analysis.

Figure 17:
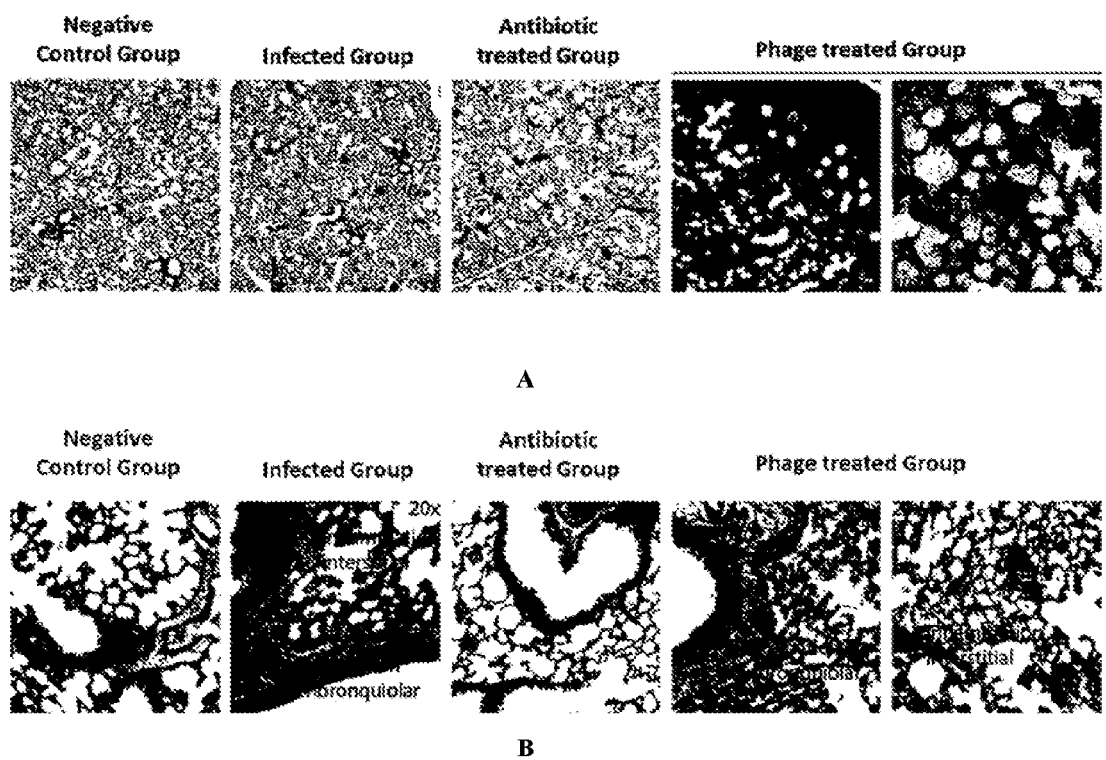
FIGS. 17A-17B illustrate (A) hematoxylin-eosin stained light micrographs of histologic lung sections of mice and (B) details of the alveolar space and septae from sections of mice lungs from a Negative Control Group, *P. aeruginosa* 1992/05 Infection Group, *P. aeruginosa* 1992/05 Antibiotic Treated Group and *P. aeruginosa* 1992/05 Phage Treated Group.

As FIG. 17 shows, histopathological findings in hematoxylin-eosin stained light micrographs of histologic lung sections of mice from the Negative Control Group showing normal airspaces, interstitium and bronchioles; Infection Group with interstitial and peribronquiolar inflammation; Antibiotic Treatment Group similar normal airspaces, interstitium and bronchioles; Phage Treatment Group showing alveolar edema, interstitial and peribronquiolar inflammation and necrosis. Inflammatory cell infiltration and bacteria were seen in both groups of infected and Phage treated animals, but multifocal necrosis of unknown cause was observed in the Phage treated animals, sohe overall results of the histopathological analysis inconclusive.

Infection and Bacteriophage Treatment—Chronic Wound Infection Model

Figure 18:
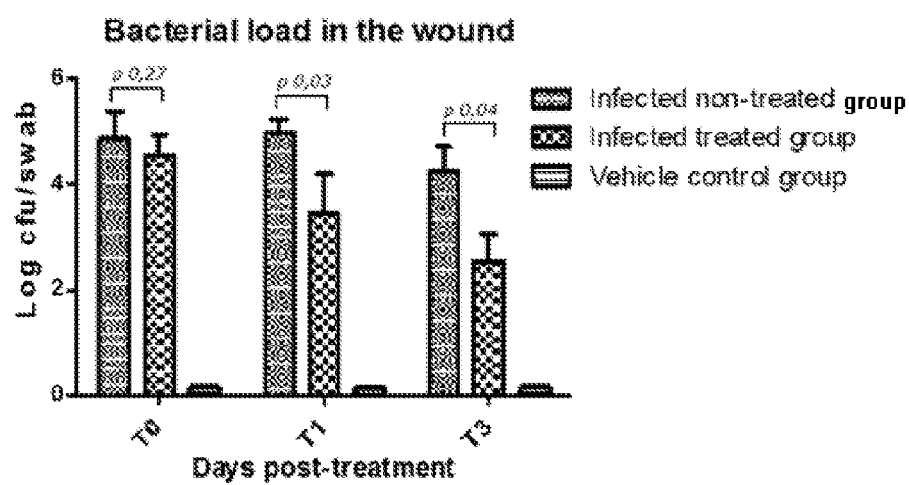
FIG. 18 illustrates wound bacterial load in which wounds were swabbed at t0, t1, and t3, and the number of bacterial colony-forming units were compared between Infected and Phage Treatment with phage cocktail of F99/10, F27/12 and Psa_F95/13 groups.

As FIG. 18 shows, the average swab colony counts in animals of the experimental groups. Wounds were swabbed at t0, t1, and t3, and the number of bacterial colony-forming units were compared between Infected and Phage Treatment groups. Vehicle control group animals showed no bacterial growth in the wounds during the assay.

Before treatment (t0), the average swab colony counts in Infected, Phage Treatment and Vehicle Control groups were $4.87 \pm 1.27$ log(cfu/swab), $4.53 \pm 0.80$ log(cfu/swab), and $0.00 \pm 0.0$ log(cfu/swab), respectively. There were no statistically significant differences between the Infected and Phage Treatment groups (p>0.05). After induction therapy (t1), there was a statistically significant difference in the bacterial count between the Infected Group and Phage Treatment Group (Infected, $4.98 \pm 0.35$ log(cfu/swab); Phage Treatment, $3.47 \pm 0.53$ log (cfu/swab); p<0.05). On day 3 after treatment initiation (t3), the statistically significant difference in viable cells counts was maintained between the Infected and the Phage Treatment Groups (Infected, $4.23 \pm 1.47$ log(cfu/swab); Phage Treatment, $2.55 + 1.34$ log (cfu/swab); p<0.05). Vehicle control group animals showed no bacterial growth in the wounds during the assay.

Histopathological Analysis

Figure 19:
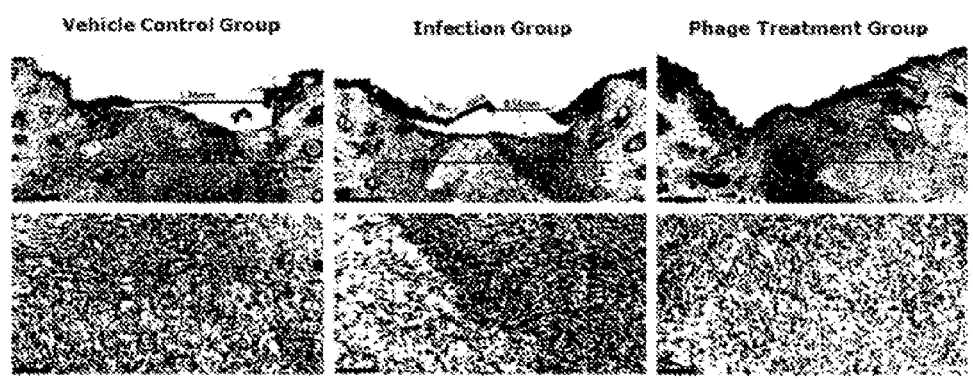
FIG. 19 illustrates the microphotographs of skin wounds in rats exposed to *P. aeruginosa* 1992/05 infection, phage treatment with phage cocktail of F99/10, F27/12 and Psa_F95/13 and vehicle.

As FIG. 19 shows representative microphotographs of skin wounds in rats exposed to *P. aeruginosa* 1992/05 infection, phage treatment and vehicle. Epidermal gap length and dermal wound length for are depicted. High magnification of the granulation tissue shows wounds at different healing stage.

The results of the histological study revealed that the microphotographs represent just one wound of each experimental group. New analysis is being made to enable statistics analysis. However, it can be observed in the wound from a rat of the Vehicle Control group inflammation and tissue formation, in the wound from a rat of the Infection group mainly tissue formation, and in the wound from a rat of the Phage Treatment group tissue formation and remodeling, with hair re-growth.

The lytic activity of the newly isolated and characterized *Klebsiella pneumoniae* F391/08, Kle_F92/15 and Kle_F105/15 bacteriophages was evaluated against planktonic cultures of *K. pneumoniae* 121/15 strain in order to obtain a bacteriophage cocktail to apply in an animal model of infection. Conventional lysis curves were performed in controlled conditions using a previously determined bacterial inoculum. Cultures were prepared with an inoculum of approximately $2 \times 10^6$ cfu/ml. Each bacteriophage tested individually and in combination, with MOI approximate to 10 (FIGS. 20 and 21) to screen their efficacy for potential therapeutics. Viable bacteria counts were monitored at 1 h intervals for an 8 h period and again at 24 h.

Bacteriophage F391/08 was tested individually at MOI approximate to 10 and within the first 3 hours' viable bacteria counts were reduced by approximately 5 log units compared with the control culture of bacteria. Afterwards, bacteria began to increase and 8 h post-infection of the culture viable bacteria were at 1×108 cfu/ml. At 24 h incubation, viable counts were at 9.8×109 cfu/ml. This was observed for the 3 bacteriophages when assayed individually and probably was the result of the appearance of less susceptible bacteria to the bacteriophage infection. Bacteriophage Kle_F92/15 was used at MOI 10 also against $K.$ $pneumoniae$ 121/15 and in three hours reduced the viable counts of bacteria in approximately 5 log units when compared with the control culture of bacteria. At 8 h incubation viable bacteria were 1×10$^8$ cfu/ml, however at the end of the incubation period (24 h) viable bacteria were at 6.8×10$^9$ cfu/ml, slightly lower than the values of F391/08. Kle_F105/15 bacteriophages revealed a higher efficacy against strain 121/15 than the other two phages. At 2 hours' viable bacteria counts were reduced by approximately 5 log units compared with the control culture of bacteria, reaching 5.2×10$^2$ cfu/ml. At 8 h incubation viable bacteria were increased with 4.3×10$^5$ cfu/ml. At 24 h culture this phage was able to achieve an 80% reduction of viable cells compared with the control culture of bacteria. The distinct behavior, shown by the bacteriophages in culture, probably reflects the differences in their adsorption rates, latent periods and burst sizes in this strain. It was expected that the combination of the three bacteriophages, F391/08, Kle_F92/15 and Kle_F105/15, in culture with $K.$ $pneumoniae$ 121/15 would decreased more significantly the bacterial growth and that was observed. Bacteriophages F391/08, Kle_F92/15 and Kle_F105/15 with MOI approximate to 10, early lysed the bacteria reaching a ~6 log unit reduction (viable bacteria at 2×10$^2$ cfu/ml) when compared with the control culture of bacteria. Viable bacteria counts rapidly started to increase presenting, however, at 8 h culture an ~3 log reduction when compared with the control culture. At the end of the incubation(24 h) viable cells had increased considerably, showing just a slight decline (29%) when compared with the control culture.

The purpose of this study was to produce a bacteriophage cocktail against $Klebsiella$ $pneumoniae$ strains with bacteriophages that displayed a broad activity against this bacterium to be applied in relevant animal models of infection.

Certain modifications and improvements will occur to those skilled in the art upon a reading of the foregoing description. It should be understood that all such modifications and improvements have been deleted herein for the sake of conciseness and readability but are properly within the scope of the following claims.

All publications, patents, and patent applications cited herein are hereby incorporated by reference in their entirety for all purposes.

SEQUENCE LISTING (749 sequences)

SEQ ID NO: 1 - DNA, 92792 bp, Pseudomonas bacteriophage F99/10
gtgatccagtatctcccggagaggcccgggttaaaaacctcctagtttattgccctcgttggccgagaggatcaggcagcagattgcaaatctgccatacatcggttcaaatccgatacgaggctccaaagttttattccgtacggcccatcaaggcgatggggctcggctgttaaccgaaacgcgctaggttcgattcctaggtacggagccaatttccaaaagagactcttcgctttagaagcagagtcgaacgcccgatacgggccttattatctcctcgtagctcagtctggttagagtgtcggatttggaatccgaaggtcgaaggttcaaatccttccggggtgaccaatttaaagcgggtttcgtatagtctggttattattcttggcttccacccaagagactagggttcgaatccctaagcccgcaccaaaagtcgtagacctcagtaacccggagtaacgcccgggagaagatgtgagttctacgtatatgcgcttgaagctaactaggtagaagcaccgggttgaaattccggaggacttggatcgttaccaagcgggcgcaccaaacaacgcagttatagattaattggttaaatcgccagactttcaatctggtgttccgggttcgatccccggtaactgctccaatcaagtccaagccggaacattcctccgtatgtgctttcagccggcttggcattattcgtgtggagattgtgtagcccggatgctgcctttcggttgtgacccgattgttggggttcgagtccccgcctccaaccaatgtcgtgcaatggtatatcgcgttgacgcttttaggctctctggatcgtaagccagtaaagcgagaatagcgggctctcgcagcagagcgataggtggttcgattccacaacatgacactctttcctcctcgcctgtgctgaacggtttcctcctcctttcccgtctcacaggctctattccctgccctttaagcatttatggtgatgcaccggctttgtaacccggcgaagtctgttcaagtcaggcatggggcaccaattcactatcacgaacccacaagctcccgatagggttcatactctataaggttgtagcatggaaaccacgaaagttcctgataaaaaactcggaccaatcgcgctagcgcttaaagaggccagagagaattttgatctcagccctcatgttattggtccaaaatctttcaaacagaaagagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggtggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagattacatgtaaccctgattacaattcgttccttcgtaaatggattgaatggtggctagaccctgacacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaaccttgaagcccttcctagggtagaacgtgaaaagctcctagacggtagctggcacgctagagaagagggagctggatacttcacaagggactggtgccaaatcgttccccatccgcctctacgggtgcttaaaagggtacgtgcatgggacatcagcggtagcatcgaatctgaaactaacagaaaccccgactggacagccggcgtgctaatgagccgtacaaaagaaggcttgttcactgtcgaggatgttgtcagagagcgtaggttgttcggaggtgttttcgacctcattctagaaacagccaagcaagacggtcaagacgttgaaattcaaatcccatgtgacccgggggctgctggtaaagcttatgctgcccagctaattagagacctagcggatcatggattccacgccagaccgaagacaactaacaaatcgaaagttactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatcccttggcagcttgattatccctgatttcctaccgcctgatatgactcaatccaacaaattcaaactaaattaataggaggcggcgatggccgagactgaaaagacagcaccgggtatcccgcgacttcgcctaggcgagattggtagtacaggccttaaacaagtcaatggtactattctggaagaacgccgaccagaacttcggttccctagggcatgcagaacattccaaatgatggcggaagaccctaccatcaaatcagcactcgatctcttcgaaatgatgatgagcagggttgactgggaagttgatctaggagttgaccccgacgaggctatgaaggcccggggtaaattcctgaaagagtgcatgcatgacatggaacacagttggtactccttcatcaaagaggtcactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagggcagtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaggaccaagttggctcttactctctagctggtgccaagactaacatcatggctatggcgattgaatcgcggctccgcgaaatcaaagacgtactagataataaactcattcctacgctgttcgcactgaacggtgattatagtccagacttgccgaagctgcaatacggtgagctagatgaaatcgatcttgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaagcaggtaaagctggagtaggtaatggtgcatcaacatccgcagccggtagagacaacgccgctgcaaataacgcataaggagacagaatgctgactcttgaaagtgttattgaagctctcagcaatgctttcggggctcccgccaaggcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtccttcatcgctccatccgcattcacaactgacgacggaagagagatcaagaaaggtacatggctccagtggtggcacttccctgaaggctctgaagtagccgatgcactatgggaaggcgttaaatctggtgaattcacaggcgtctctatcggtgccagagctacagtcgaggatatcgaatgaccgtaaaagcaaaacgtaaactgaccgatatcaagtttgaacacgaaggtgctcatgtcgctctggtcagtaagctccaaggtggtgcagccaacgggcacactactctaatcacaaaagctaccaatggcgtaactgaagagcttatcgataaagctgctgaagttacagtcacaatgcagttccctgagttccttcgtaagttcttcgggatgtattatgaagatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctattgcagttgaaaaagctgctggtgtcgctgctgttgcagaagttcagaagcaactagacgccgctaatgtagagcttacagctcttcgtgaaattgtcaaggctgctgaggcagagaaaaccgctgctatcgctaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaattaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgtcaccttcgcgtaagcgagggtcgttccagtaaataaacactaggagtaactttaaaatggctaacacccgttcctacctaaacgatggtcagttctacattgccgaccagactgaaaacctgcttatcatcccgaacacttggaccctcgtcgagaacatgggcgtcttcacaagtgaaggtgtgactcagaacactgtccagttcgaagagatcgaaactcgctacggtctggttaaggatgccatccgtggaactcgtcaccaagttgctagcgaccaacgtcgtcaactgcgtgccttcgcgattccgcacttcaaccaagacgactacatcactccagaagacattcaaggcaagcgcgctttcggtgctgaccgcgaagaaactctgaacgaggttcgtgctcgtaagctggaaaccatccgtcgcaactgggctaacaccgctgaagttgcttccgttagcgctatcgtaacaggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggtctgatccgtggggacttcgttgccctgtgctctcctgagttcttcactgccctgattaaccatccgagcatcaaagagttctacaaagcttaccaagctagtcctcaatactggcgtgaacgtctaaccgctcgcggtctggaccttcgcttccgtgagttctacttcggaaacattcacttcatcgaataccgtggcgttgacccgtacggcaaccgtctgatcccggctggcgatgcttacttcatcccaaccgacagcggtgacctgttcgctcgttacttcggcccgggcagcactttcgatgacctaggaactctgggtaaagaactgtacgctaccgagcgtatggctgaagaccgtcgttcgatcctgatcgaaaccgagtccaacttcatccacgttctgcgtcgtccacagatgatcgttcgcggcactgtgaatgcgtaaagacttcagggaggcttcggcctccctttcgtcgtaggagggtaccaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattgcaatttctttggcagtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtccacgttcgagaacgtcctacgcgatggaaggcagacgaatactcttctgaagaaattgggtaaaatggttgcagagcagatgcaagttaacattgacgactatccgggctctaacagtccggcatgggcagcttacaaaggatttaacgatcctctattccatactggaaagatgcttgagtctgtcaagttccaaatccatcggaggcaataatgctctatcctaccttctccatgaccaactttgtcaagctagatttgattagaagagggcagcccggagacgacggttttggaagacctacccctccagttgagacagtagtaacaatcacagctaacgttcaacctatcgaaaaatcgacagacactcgtatccttccagaggccgacagaagcaaggcttgcttcaaggtgtactccagaggcgaagagattcgccagttaaaggaaggcccgggagggtggagtgccgatagattcatgtgggaaggggagttgtatgaagttatgaaagtcatcaactattcgatgggaatcctaaaccattacaaagcaatttgtatgagagtagagaggaatagcacagcatgatccacacagagctagaaaactccctctatcttatggtcaaagagttgttccccgactggcgtgtaattcaagcttacacgaataatcaggaaccgcaaaccccttatctggctatcgacattaagaggctggatgaactgggaagggaaaatgtctccaatatgagcgatcccattagtccttcgcatggaactattcaagttcaacaggacttcgcagccaaagtcgtattcgaactgattggcaagtatggagagacagcaagtgtctctgacatggcaatggcgattactcgggcaatgcgtactccagcaggacacgccgcccaaagaaagtttaatctatcccttttcaaactccctagcacaagacgagttcctatgctaagagaaacagatatgtacatgttctatcaagttacatgtgaatttggattctctgtgatagaaaccacaactcaagagtttgctgctggggctgatattcacggcgtttattacgacgctggtcgcccgggtcacattattgagtcccacatcgacataaacttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccagagtctacaacagcctgaaaggtgtcgctgaagacttcggagaatccgatccaacatatcttgccgctgttcgctacttcggtcaagctctcaagccacgcagcctagttatcggtcgtagacaagttccttctgctaccgtatctgtcagtgttgttcaggaaggccagagctacgttctgaccgtcaacggactaccagtcagctacgtcagccagcaagacgacactgctactctgattgccacaggcctaaaggcagcttatgacgtaactccggtagccggcgtaaccgtcacagacaacgaagacggaactctaaccgtcgcttctaacgaagactggagcctgaaggtttcttctaacctgactatggctgctgctccctctactgaaggttggccggctgctatcacagcagttcaaggagaaaacgacgaatggtatgctctgagcattgacagccacgccgatgatgatatcatggcagtagctactcatatcgaagggaccaagaaagtgtttgtcggggctactgctcaggctaataccaaaacttccgcagacaacgacattgcttcgcgtctagtcgctggtgggttccaacgtacggcactgatgtatcatccaaacgctgacgctcaattccctgagtgtgcttgggtaggataccaactgcaagagcaaccgggtagcaacacatggacccataaagctctagctgccgtagatgcttaccgtctaaccccaaccgagtctaccaacctgaagaacaagaacgttaccacgttcgagcgcgttggtggtgtcaaccgtacattcggtggcgctatggccggtggtgaatggatcgacgtaatgatcttcgtggactggctggaagcccgcatgaccgagcgtctgtggttccgtatggctaactccaagaaaatcccttacgacgccgttggtgcaacaattctggaatcggaaatcagagcccagcttaacgaaggaattcgtgttggtggtctggctgaagctccggctcctaaagtcttcgtacctgatgttctatccatgtctccgaacatgagagcacagcgtatctttgaaggcattgaatttgaagcccgtctggccggtgccattcacttcgtacacattcgtggaactgtgaccgtctaaggacggtccttcccataaggagactactaaatggctgttcaacgtctagctacattctctccagccgatgttaccattgttatcactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctaccctcactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttccaacttctcgaacagcatgcagactcgcgactgggttatccacgctcacaacctgcaaactctgatcggcggtaacgccaaactgagcccgggcgacgcagatactctccgcaacctaggtgtaacgcttgaccaacgttggctgtaatacgccaatataccacatcgacggggagctaccttaacgggtggctccctttgttgtttctggaggatagaaattgcttactacatactcgccgcgtgacgtggtagttactctcgctggtatccattccgtgacagggtacgcagaaggagagttcatccgaattgtaaaagatattaagcctttcatcaagcacggttcgatggatggtgaaatcgcaagggtctacaacaaagaccaaggctggcgagtagagttgacaatcatgcaatcctcgccgaccaatgatatcctttcgatgctttacaacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggctttgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtactgccggccatatccgtcaaggtatgggaatggggattggtagcgagctagccgggtggggacgcgggtttattcccggccttggtggtgcgttcgctattatgcagcttaaccgtgctaaccaagaactgcaaggtcaacgtctggccatgcaagctgtcggtggtggagtacagggtggtcaagagctacaagccaccctccgcgatatctctcagcgtctcggtcttgacgatagagcaataggtagctcctatgttaagatgatggctgccggacaagcatccaacttcgacaaaacacaggttgatggtatcttccaatccatggctgaatatggacgagtgatgggtctggacggggaggctatgaaaggctccttccgtgccgtagagcagatgatgggtaaaggacagatcatgtccgaagaattgaaaggtcagttggccgaaagattccccgctgctgtagctctgatggctaagtctcaagacatgactatcgcagagctaatgaaaaccatggagaaaggggagcttaagagtgatgctctgatcccattcgccagaactctagcggaagaagctcgtaaaggtggcgctctggacgcggctatgcaaggtacagccgctcagcagggccgattccagttcggatggaaccgcactatcgaggccttcgcggctggaggattcgaccgaggaatgagcgacttcttcaagattgctgcccaaggcatgaaagaagcgcttcctctggtaactgcacttggtggcgggttcgaagctcttatgaggcctgtcaacgctctggtcggtattggaggggagcttggttcccagtgggagaacattgccaagcagttcaacatgaccggcacagggctgactcttaccacggctcaaaccctagccttgctgacccctatgggcaggttgatctctgctattagctggggtgcgttggcactggaagacttcattgtcttcttggaaggcggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgctcagggtaacgtcatgacaactgaagcgcaagagcgagtacgagagatcgttagtaacgttcttgaggaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtaaccatcccggctgttatctcaacctctagactagaccctagcagaatctttccagaagttatcactcagtttattcctcctgagattccttctgcaactgtcctccctcaaaagggtgataaagtcgcttatgatattgagcgccaactgatcgacatgcagcgtaatgctgaggtcttcagtttgctggacttccgagacggtatcatctgggatcaaatcgaaagatgcatcttcaccgacttgtctttcactgaaaacgccgagacaggtagcagccttcaacctcgtatgacaatcgaggctgtgacattcacagatactcgttatgtcgaggtgagggttaacaagggtagaaagaccgctaagaaagaaaagagagacaccaaagaaggtgataccggggctagcaatgctaccagccaagactctcctacattcaagcgtagtcaaatgaaagaggctcagattagaactcaggttgcgaggtagactaaatgagcacgacttatatcgacacacttcctctctaccaagaccggaagtacagatacgcagtagctatcgagggaatctcaagagtccttcaattctactggaatagccgctctcggcagtggcacatggatatattcgacgaggaacttaaccctatcctgacaggactggcggttgttcctcagtatccgatcatggcagactacgccatgcaacatataggtttcaatggctacttcctactgatgcctgtcaacctagaacaggtacagtataagcacgatgcaagtgacattgtaccacagtttttcgaactgctatacgtgaacgttgacttggaggatgacgtagagtgaaacaatatgacagagtgtataaactaacgctcggtaacactgaatccgggcaaggtgtagagattacaaacctccaccctgacggaagtttgaacagagagggacttcagttccggtttgatatctctaaaagttcagataacaagaagagcggaaactcggcgactgttgagatatacaatctgtctattgccactctgaacattcttgaaactgagtatctgacgtgccgactagaagttggttataaggaaatgggaacttctgttgtgcttgatggcaacgtggttgaaacttcgactagaaagagtggtaacgattatgtcactcagcttattctaggtgaaggatatacagcactaacagagaccaagctgaagggcacagtatctccgggcaaaactgtaaaggatgttatcgaagaaattcgtcttcaaatgccgggagtggacagaggagcttatacaggcctcaattgcaacaacccgatcatgtatggataccaactacgtggactggctaaagacgcactaaacagtgtgtgtgaagccaacaatattgaatggaacatcagtggaaacgttctaaacgtcacagacgttaacggcccaacaacgaagagtgttcaaatggctcctctcgtaaacagagagaccggcctgattgatatcccattctacgccagtgccagcggaacagcacagaagaaagaccagcggagacggaggggcgttcaattcaaatgccttctcaaccctgagctaactcccggggttcttgtccgggtagagtcggacagattgtcaggcactttcagaatcaacaacgtccgaatctcgggcggatacagagacaacgaatggtacactgaatgctggtgttccgatcttaaccaagaggatattgaccaatgaggagaacaggcctacaagagcttctgaacctgcactcgtccacagagggttcgaagcagtacactgccataccttgtgtggtattgcgcgttctggacgattttagacgcctatctgtcgatgttagaccagtggtcaacgacctgtacaaagacggcacatcggaagagcaaccagagattctatctgtccctgtcattatgccgggaacagctaacacacttatcagcttcccattgaatgttggggatacggtgttgtgtgtattctctcaaagaactatggacgtgtttaaaggttccgccaccggacagccacacactccaaacgatcttcgtaagttcaacatggcagacgccattgccattcccgggctgttcaccttccctagatcgatgaacgaccctgcaagacatagttggccgcacgacaccaaagacctcactattgcccacaacctgatgactggacaagaggccgaggttaggatcaaagctaatggagacattctaatcaacagccgtaagactataagcattaatgcccaaaatgtcaacgtaaagtgcgcttccctcactgttgatgcagcccatacaacatggaacgggaacattgcacatacaggtaactacgtgcagactggtggaacctctacattcaacggtattccattccatacccacaaacacggtggtgttatgccgggcggtggtgttactgctgtcccacaagcttaaaggagatcatatggacttgtttgtcaaccccgacacacatgacttggtttttataaatggtgaagctccagtcactcaacgaatggttgatattgtcgctcagcgactaaagatcaaactgtacacattcttaggtgagtggttcttggatgatcggatcggcatcccctacttcgagaggattcttggtaaatctaggagtcttcccgctgttgacgcgatattccaatctgagattatgagagaccccggcgtccttgagattacatcttggcagtcagggatcgaccctcacacccgtgaatactccatggagttcacagtcagaaccacagataatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgtggctctggataacctagtatccttctcggcaattagccggcatgctgcacgtccgacccgggctcaggttgttctagagggcaacatcgacaccgttattaactcgcctcccgcgaagatgatttccagcagtacaggccgagtgttccacctactacaaggcgtgatcctcactcctaaagcttgctctggtgttggaatcttccctcagacagtaggcaacgacctgacgtacgagcttaagatgtacgttgatgacattaacacaacgtctatcaagtacacaagtcctgccactggcacagtaacatccgagtccatcctagcaggactggccgccgacgtagctacaaatcacggaaataccttgacaagctacgaacagaatggtatacttttcatagtacctattgacccattcaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgtgagaccgacgatgagcttcgcgagagatttcgaaactctaaattcgtacaagccaccaacattctggagtccctgatcgacggtctgatgaacgtagaaggagtcgaggatgttaggattatcgaaaacgataccgacaacctagaccccgttcacggagtcccgggtcactcgttccttccaatcgttcttggtggtattcctacagaggttgcacagtctatctggctgaacaagccattcgggattggctctgttggagatacagaggttcaggtggtagacagtctgggctatacccatagagtcaactaccaacgccctgttgaggttccaatcgagatcaagatcagtgtaacaaacacaggatcgatgccagagaacattgaagatatcctacggccaaggattgtagcgtacgggaccgagaattacaagatcggagacgatgtaatttattctcgattctatgctccaatcatggaaatcccgggcttccaagtgaacagcctgacgattgccaagaaaggacaaactcaaggcatggcgaacattgaaatcgggttcaaagaagtggctacattcgccgcagcagatatcaccgtaactacggtgtaatgatagaaggagaattccatggctgtcaaccaatttgacagagaagattatctggaggtggcccgggaacgggtcactgaacagtttaaagagaagccgatctttgatcgcttcctgcaagtgctattgtctggtaagtttgatatccagaatgcactggaagacctccagactctccggtctctggacacagccaccgggaagcaactggacattatcggagacattgtagggcgaccacgcggtctagtttaccaagatattttcaactattttggattcgctggaacggagcgtgcaggttctttcggaagcctgtcggaccctacggtcggtgctccatggtactcggtcggtgctccaactggtaacgccagagagccgagcgatgaagagtatcggatgatcctgaaagcaaagatcatcaagaacagaacaaactcaaccccagagcaagttatcgaagcttataaatttgtattcggggttcctgaagtattcctagaggagtacgctcccgctgctgtccgtgtcggcatcggtaagattctaacgaacgtagagcgtagtcttctattcgacctaggtggtgcaggtgcattgcttcctaagactatcggggttaactacacacacactgagttccaagctggccgggtatttgctacagaaggcttccccggaggacaaggcgttggagacctaaacgatcccactgttggtggaattctgaccaacctagtgacataaggagttataaatggctgattacagtcaactacctattgaaaatatttggtccacaggcggggatatggtagccccgacccctgcgcagcagcaaggcggatggggtattcagtcggttcctcgccaatggtggaactggaagtggaaccttcacgatactaacctagcgtatttgctacagaagggcatcccagagtggactagtacacaagagtacattgctaacaaatcgttctgcactagaggtggatttgtttacaaggctgttcgtacgcatacaggaagtgaccctgcacaagttagtgccaactgggttcgagcttttgcagattacaccacagctagttcagcactagggggcctgactccaagggaaggaggtattcctttcttcattagcgctacaggagctagcgtgtttgactctacggcctatggtcgcggaatgttgaatgtagctaatgcctccgcagctagaagctacatttcggctcaagaaagctctgttgtactgtccaacctgtccactgtgactagggctgccaacacggttccgtacttcaacacggatacctccatggctaccttcaacatcacagcgttcggaagaggacttgtcaacgcggctaatgctgaaaacgcaagaaatttcctaggactagctaactctgctatcattacggcagacccagctaacagggcacatactctggtctatagagatgctgctggcaacttcaacgctggcgtaatcactgctaccctgtctggaaacgcaactacagctaacaagcttagaaccccagttacaatcaacggtgtggcgtttgacggaagccaaaacattgttcttccgggcctagatacaagttatgcgggaacggttgcacgtcttcacatcaacggagcgaacctttcgagtgcagataagactactcagctagcactgaggaacaaatctgacaacgactggattagccttgctgtagtggatgacaacattctccagtttgtattcagaagcgctacaaacccagttgtccagattggcaacgaagttatccttcacacaggaaaccagttctctctgggcccgactcttacagacgctaggtctcgtctgggtctcgacagactcactcaaggtagctctgatactcaagtcttccccagcaccttgaacaatggcccctacttgaccgtacaacctacggctatcggaggattcaacggtagcactaacggatggctgttccgattcgacgctaatggtaacatgactcatggtacagttcctgccgctagaatcactggtctgtccaactcggctcagattccagccacaactacggcgcaggctaactctcttgttcagagagacgcagacggaggattcagcgctattgcgattaatgcgtatggcactatcgtcgggtacggctctaacatcttcagtagagcatcgggcactggcaacgcccacatcgggttccagagagcgaacggaacagaactcggtcttatctggggggcccagtctaacaactcgatgaacttccgggtagctggtggctccaccgcagtgtcgattaccggtctggacatgactgttactggaagagtcaatgctaccacactaaacgcctctggaaacgtgaatgcgacaggtaacgtcaacgccgggagtgctacactcaatacagcagggaacatcacaggggccgcctacggagcgtatggttctcttaccaactgggtagattctgtatatgcgaagaagggagagattcctaacgatatcgctagagcaggcgcagcttgggacgcagttggacagtacatcctagctggcgatcaatctggagggtctggtggaccggggacaactagagctggaagccagttgaagccttattcgactattagctacacagcaggggcactaccagcagcaggcacttacagatgtatgggagcgtttgcaggtggtggtaaccagattaccctgtggcagagaatttcttaatagagggcttcggccctccttttagaggagattatagtggaattcagaaatgttgtaaaatacaaaatggggttcgaatgcgaggtaaatcatcctcagtggggatggattccgttctacgcttgcgattacgacgatagagccaaactggtatatgacgccatctcccgtgctgtcgataacggagaaatccccgaaccaaaggacgttacagatagagacctcgttgtagatgcacgtctgtggagagataatgagctaacccgggctgatcgtcaagtagaaattgctatcgacgatgaagacgaagtaaaagagaaggcttggcgtaagtaccgctctgcactacgtaagtggcctgagcataaaaacttcccagccgagaagagtaaacccaaagctccgaaggagtgaggtaagataatatgccaaacattatgaagcctacgggaatcaacgctatctggtctgaaaatggccagaaggttgacccgggtgctgtgaaagtagggctaggctgggttacggaacttcctccgtaccagactgcaaacttcattgaatataaacaagacctgtttaacgctcacgtcaaccaacatggtatccctgaatgggatagcgtgacagagtatcagggtaacctgagctacactcaaggcgctaacgggatcatttataagtgccttagaacccattccgacaagattccaaccgaccctctcaacatcacagcaggatactggcgggtggcgttcgaggatgcaggggaggcggccaaggttcaagctaaccttgatcggcacgtgacaaattacaacaccctctctgggattggtaacgtagttattgcaagacagaacctgagtgtgtatagtaaggccgaaggcgatgcacgttatgccatgcggcacggcaacgggtctaacgtcttcagcgtcgctcccgcaacacagccaactcacgcgatcccgctgagccagctatcgactctcgttcctcctgcgaccgagactgtagccggggttatggcagttgctacgactatcgagacagaagctggagccaatgataccaaggctgtgagtccgctcaaggccgcacaggtgtatctgaagaagaaagacaacctttccggtctgtctaacgtcactgccgcaagagctaatctaggactgtcggatacagcgactatgccttcttctacattcctgaaggcaggtagcaatctggcagatgtgcctaacaaggcgctggcaagatcgaatcttggaattacaagtagtgctacccagccggaaacctatttcttgaggagcgctcagaacctagcagatgtacctaacaaggcacaagctagagtcaacctaggcctcactgggatggctacaacagaccctgcggcggttatgatgaaggcagacaaccttgctggattggctaacactgctaccgctcggtccaacctagggctaggcacagcttctactagaaatacaggagacttcctgtcgtctggggataacctgtccgacctcacgaacgtccaagcagctagaaacaacctagggttgaagggagcggctacgctcgatgtatggggtcttcctgcgaatacaactgctatggacttccagtctaatcagtcggatatttccagaggatgggctcgactaccaaacggccttctgctacaatggggaactggtcccggtctgtctgatgacacaaggacgaatatccaactccctgttccagcacgaatcttgaacgttcaagtgaccgtaatggggacgtttaacaactccatcggcccgggcgctttcatgacggatatgtggagcaacacagggttccgagttagctgcaactggggcaactggtcttacccgttcaactggtttgctatcacttccaccctgtaattcaggagtatcaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggcggacaagcggagcacgaacgtctagataaagcagtcaagatggatagagactgcgcacttcaaagtgcctcttggggcctattccagattatgggattccattgggaggcactaggttatgcgagtgttcaggcatttgtcaatgcccagtacgctagcgagggatcgcaactaaacacttttgtgcgcttcatcaagaccaacccggcaattcacaaagctttaaagtctaaggactgggcagaattcgcaagaaggtataacgggccggattacaagaaaaacaactacgatgttaagctagcagaagcctatcaatccttcaagtaaatctaggaaggttcctaatgaagaagctattcaaaagctggaagttctgggctgctgtaggctctgcaacttttatggctctggaagccatggttcatctttgggagcctatccttcctcccggcgtgttcgccgcagtagccacactggtagctgttggtgtgagaatttcggcagtgtttgtaactgctggtaaagtggaggaagcgatttcggaaaccatagaagatggctcaatagaaaatgatactaactaaactcaaaaactacgccctcgtagtagctgccgcaatggcagcagggtttggatatctgtcgttctctttgtacggcgacttagctgttgcgaagaatgatatccaatctcttcaagctgcgtctcgacagatggaagagcagttccagaaagagcgagcagggtgtgagatcaccactgggagactagaggcgcatatagtccaaatgaagagccgacaggagcttctacaaggccacctgtgcgagcttgagtctctacctaacccaaccccaagggagacccaagaaaatgccacagagacgatctctgagccttctactggggatagtctggaccctgctcttacaagcttgctcgacagggccttctgttccgcagtaccaaacgatccttattgcgcccccggcaagcctgaccgaggaggttaaggtataccgagtggagcaagatacagtcaaggggctcgctagagcttacattctaaatactaacagtgctgccatgtgcaatagtcaactacagacgataaagctatgggcagaagagcagagggctctgtatggaaagtaaagacggcaaagaaggcctaatcaaggtagctacacagggagttatctctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgttatgggctttcagcggacaactcgatgaacttcgtcgaacagttcgttaagcttctggatgaccttcttagccatcttattgcgagctttgttagactctgggctggaatagatcagcttcatgtcgacggcgttgccccagtctacattcccgtcctcgaacaaaactttaacattcagattcatcgagtgcgagtcagtgtcgataactactccaatctgcatgctattggacttttcgaaggtcggcctcggaatgtctatgtccagactaccaaccataacaacctgccctttcttaacgtcggatagttccattaaaacctccttaatctaacttcattagtgtgttgaactgatgcctcagagacttaaaagcctgtggtccgtcgtcttccgctccttcatgaatgtggtgagcgataaggtgtatcagtcctctgtctcccagcaaaatagagctaggaatctcttttatccaagctacaaaacagcagaagtgcaatacctctggcatagaagccttgaagctggaatcgtccagcttcgacaggcggttatacgtggctttgagatcgggataactcaactcatacgttgcatagtcgtcgatgtgctcatcaccactcaccatatattgcaagctcattctacaccttcttgccgccttctgcaaggcgagcttcccgcttgtggtctgcacgggtcatgttgtactcgatcttctcgatcatagcccctgcaacatccagaccccgtacattcgcatagtccatgatgcgaatgatagcgtcggccagttccacctcttccatcttccgctctggcaagtgatcgtccatcaaatccttacggacgccttcagcagcttccgcaatttcagtggtaacgagcatcagcatatgcagagcatcacgtttaatcggctcgcctgtgaccagatcggtgttccacttgcggttaacaacctcaagaccagtcatcattttgttaaaaccgctaacaaactcgaagacggactctcgttcgaatagttcaccgaacgtcggctcttgatcttcaacaattgcagtactgaaaggccactccatccaagcatcgtagcactttttgataagctcttgttcatcaatgtacgagaagacaccctgttcctcaagctgactaatagcttcagccccctcggcccagacgcacgtaccaataagccttggatcgattctcagagaagtcttgtagacttctttccacgacctccatcccaccctaccattgccaaaatacacaaggagtggcacatagccttctcgcttttcctgctctggcgtttctataactacaacaaacgccggaactttctccccatctggacgttcagttagtacgaaatctcccaagttgatattctcccgactagctgggcgaagagcttcctcgatatggtctttaactttactcattaacttcttcctcctcacagaacatttcaaaatagcaatcacagcataccaacatgccgccgtcatttacaatttcttcgaccgggagaatgcttccacagcattcacacccagcccgttcgacagcatctgcacaggcccaatagtccatcttcaccctccttcactcctccttcagaaggtactcgttgctaataaccttgaaactaaagtctcggctcatgcttttgaacaccaagccttcccggtacttaccgttcaacgcagactctccgctagccatttcaattacatcttgcatgtcttttggaacgcctacgtcccacatgtacaccggcacatgtttaacatcctcttcgccgtcatcagctagcgcgttcaggattcccagagtggccagtcgctcttctggaagatagtaacgactctccgaaatgttgtagatatcgtacacatagtattccggtttgtcaactccctcgaagttgccttgaatattcggtgcaaccagttcaccctgaagggcgatatttagaccaaactcccggagacgttcaccaagattaagctcttctgccatcgcagtgaagtgattggagtctttcttaatcacacgcttccagccacgacccttaaagaagttcttgacagccgtgaagaacccgatcttctcgtcttctagacggaaaccgacatttcgagacgccacgcctacttctccgtccttgtgccagatagtgagagacgaaccgtccaatttgaatgtcacttcaaacttctcgtccttctgatgagcctgatcgtaagccatctgaatattctgtacgcgagcctgatccgtcttcgggatgaagttggggaaccctagcttggaagtgccagtccggctgcccttgttgcctccgttgataactacctgctcggaaggctttacatacttcaggatgcccattcgatcggtaacatcttcgtctactttcggctctggactgcccgctgcatgaacaggtacgatcagtccttggctaagctctttgcgaagcttcatggtcttgattcgagaatactcttttccaccttgttcgaccatattacggccacgcaggaattcaaagatagggttgtctacagggaccatggagtccacttcaatgtagattgccagatcgccagccttatactccccgcgtttgattacgcactgccaacctccaacaagcgccagatcgaggctgtcagcgttaggatgggtcttcacatcatcgatacgaactactcgggcaagtacgcggtcttgggaattactcatatgttatcctccttgtttgaaaattggtatattacttgttaaaccaaccgaggtcaatagctcgctctaaggccagtagcagattttcagcatctagaaggtcacggatcgcgatccaactgccgctgtctcccggtagaccatctgtgatatatacaggtatgtcgctgtactcgctctttttaagcccgcaggcacaggctacattgtctccgaagacaatctcgctgacttcccttgcctcgtctcgaatatcaatcttcattatgtttttctcctgttgtgttgaaagtcgttgtattctgcatggattcctctgctgtgtcaatagccttgacaagaaaataatccgtggtaaagtgggtgacctgctggagagaaatgtccacgtcactcaccggccagcagtatagcgtatgaagaggaaagctgcaagcgcaacctgagtcgaatctgagaacagggcagcgacgacccgaaaggggaaagctcagagcctataaggagcccatgctccccgctcaccgactcatctgcatatgcgtatatctgcatgagagcgagaggcagaccagaggcatgtcttaggcggaaaaatccgtatggcaagcttagggacaggtctgcctccactaccgatctatctgcatacaagggcttgacattaccttacaaactgtgtagagtgtcctcaaatcaatcacagaggaggtataaatgaaacatgttatttaccgagaagacctaatcgacctgttacgcgaccgtatgaagctccaagcgctggaggctggtggcgttgacaactgggactggtatgaggcctcgctaatcgactgcggatacttcgatgacgatggccgggagctagaggtcgaagctcttgcagattgcttcccaaccgtaggtgcgtaaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacccggatgctctaccgggaggatgctaaggataagactcttaggcagtttgctgaggaaaaccctgaaggtcggttctggatcgcggtaaagggtcacgctattgcaataatcgacggagtgttgtacgatcacactaatgacaaaagacgtaccatctggcactgctggcaagtgtggcccggagaggcacctgaaaaaatcgagaggaagcctgatccaatctcacctcctgtgagaaaggccccggactggtatgtctaaacacaaacatctgaagtacaaagaggaggatttatggaaattatttcgagagggacgctccctcaagaggctttgtttacggctaagtgccaccattgcctaagcattctccgagctaagagatcggaacttgagtatgtttcgttctcattctgtcgccccggggagactgggtattatttcgcagaatgccctgtctgtcacgaagaggtgactgcttgggttgcagtccctgtcacccatgtagcacctcctacgacagagtacgtagcaaaggggcgtgaataacatggatcagttagcgggttttatgggcgaacctttcgtaattgcgttcgactacgacgagacgatcagtctataccctttggccttccgagtcgtcatggataccttcaggggctttggaggagctttcaatgtgatcgtagtcactgcacgtcaccctgacaacagcggagagctagagtggctacgggattacgggttcccgatctatttcacggcacagaaggcaaagcgtccattcatggaaaatcttggaataaaagtctctgtatgggttgacgacaacccgttcagcgtggataatgaccttcctccgtggacagcggagcaatacgacgcctaccttgaggcaaagaagcaacgagctatcaacagagggagtaaagcatgagcgagattattaaggttgaagtgggagatcgggtggtccttaaggcctattgcgatacatacactggatgtgcaaagcgatgggcgcaggcgcatggtcgtttgcatgaactgctagctacggggtttgtagaagacagttgggtccacaccgacgaactggccggaggcttgaaaggcaccgttgtgatgactgaactgggactgaaggaagagtgctgtgcagtacgtctagacgcctacactgaccacagggctgttgtagttgtcgacgcttctgatctttacatcgcatgcaaggcagcaaaagctcccgtaagcaccctagacgaggccttcggttgtgaccacgactaccttatggactctccggctaacgctcagcgactgaatgagtctgtcgagcagctacggactggtcaagtcgtagaagtggacgtgcctatgagtgtaaagcaagacgaaactccacctgtcgtagtgcatgtagtagagaagatttacgataggaaaggtaacgtacacctcattctacagtatgaggtagcaggggcgttaatcaggacggtggttgaacagggagaactcatttacttcttggatgaaatgcaaggtatgtacttgaccaagattcaattggaggtgaacaatggagttgtatgaccagtggcgtaagtatatgagcgtcgtaatcttagaagaagaagataatgagcgtcagtgcatgcggcttattgaggcagttggcgaactcgatccctatatccaagatttcctagattctttctctataaaaactgaaggaggtgtagtatgagtatgagtggcgattccgtaatcaaagcagaaggcatggagagctatttcatttcccactgggatggttgggatagtatggatacagcgtgcttcggcttttatatcaagcctgaatacgttcttgacccggatattcgaaagcttgagccgagcttcttagagcttgattttgagcgatgccgattcacattctggggaaacgcagacgaaggcctagaaggaaagctgatggaaggtaagatgcacattatggcccctgccttcgagtacgtcttcttcaaggaggtttgagtggctagacaggcttacgagtctgcatcagatagggcggtcgaagaggccgtccgttctgagcttgagggccggtggaagtgttctcttcataagctacctagggcccactacatggattgggctgcctgccggaatggaaaggttgtcagctttgtggagcttaaagctcggaacaatgaaatgcagaagtaccccgacttctttgtgtcccagatgaagtggctccatgggatcgaaatgcaaagggtgtttgacattcccgcattccttgtggtaaagtggacggactatacaggatatgtcaaaatgacagccaatggcgtcaactacatgagcatgggtggcaggattgaccgtggagactggcaagaccaagaagttatggtccatatcccgctgaaagacttcacacgtttataggaggacaaatgaaacgactctgctaccgttgtctgcatcttggagagcctgtcatgctccgtcataagactggcatctggtataagggttgcagtaaatgtggatcaggagtattctatggctaagaagaaccccgtgttcaagtttctaaacacagtcaacaggccctcggtagagagggataaaaccaaatacaggcggaagcctaagcataaacagaaggagcgattaaatgaagaagggtgataaagtgaggatcaatgacgatgctgataccatcttccggggccgtgttgccactatcatcgcagtagacgaagagggttgcgttattgacgtgggcagctacgaagacgaaagcggagagcttatcgagtacctgcacctgttcttcgagcgttctgagttgtccaagcaggtgtaggagggtataatgaacggacccgagtgcagatggtgcggagagaaaactgaagctgagtttgtagacgttgggcttggatggatgcagcaagtcactggaggcatgtgtcatcggtgtggagggtacgagaatggttactaccagaacgacggaaggctcaccgaggtcgagtttgccacctactggagcggtccgttcgaagatcatgcggatttctcaccattcaaccacatgagagaaggcgactcgccatgagagccacagtacgaaaccacaatctgctatacatctacttccacacgttctcggaaatgaatgagtggttgacagagaacgctgtagatcagtggacagtcactactctgggctccggctatcaagtggctgttcctatggaccgtgcaatgcgggaccaatacgcctcggagaggggttgacacgaacacaaggtgatgctaaactccgtggttgtctgaagtaaggaggttttatgtccaaaatgaccgtggcccaaattgcggctatgcacggtatcgatctgtattctgaccacaagactgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaattccgtgggaactgaatttaacgcagagatcaacgctcaaattaaagagcaatgctcgtatgatccgcgtggttatcgtggcctgtccaaggaaacttgccagtatttcggagtgctacatggtttcgacccggagactggcgagattgcaactcagctatatcctactactactaattatgaactcactggctacaaacagcggatcatgccgaagaacttctcagagcctatcggcgagaccgggaaggattgcgagctttttggtcagttcaggttcaagaatagcaacagcaagaaggtgcttattgtaggcggtgaggttgaccagctatcagcattccagatgctcaaggagtatgatgaccggcgagcaggcggtaagagtgattatgaaccgactccagtggtcagccctactatcggtgagagtggggcatggaagcagctacaggctcagtatgagtggctagaccggttcgagcaaatcattctctgtttcgacagcgatgacgcaggacgagaggcagcagacaaggcagccgataagcttccgaagggcaaggtgttcatgatggaaatgaaccgtaaagaccctaacgagtatttgaaagctgggcgtcaatcggagtttgtcagtgcattctatcgagcccgtacatggacccctagcggtattgtagggtctgatgcactcgacgctcgaatgtatgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggtgagaaggcagacttgtacgagaccgttgaagagaaagtggcgttccttgatcggcaccgtgacgctcggtacgacttgtggcacaaggaagacggaagcccacgcttctatctgatcgatgaccgagacggaagcctagcagccctcaaggctcaaatcgaacaactgattattcagtttgagtgccgtgttattattctggacccgcttcaggatattctggacggattgagcaacgaagagcagtcggtattcatgcgctggcaaaagggtatgaccaagagccaccgagtgacgttcatcaacatcaaccacgtccgtaagagtggtggtggtcagaaggctaactcggcaggtgctgaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggaatgatgggcaattggtactacgacgttgagactcatacaatctgggacttggacgactatctggaccgataccctgacaagcgccgtgaatacgaggcttggatggctcagaaggaagaggaaggccgggacacggaatactaaggttgacagaggggtgatgcttatgtatcatccctttcgtcgtttacaggaggaaaggaaatgcaacaacgatttgaaacaatcgagcaatacctcgaatggatgggaaataacaatttcaccaacatgacttgggatatcgaggccacaggcctgttggatgaaacgtctatcgattacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtgctcaagcgcaagatcaagcgcgtagtggctcacaacatgattaacttcgaccttatgtcgatgaagcttgtggaagatatggactttactatcggcgtcgagcacagggatggtggtctaactacttggtcggcagatacttggatgggcaagcaggtggtattcgacgataccctcgttatatccaagacttgtaaccctgacctgttcggcggtcacagtctggacaagctgtctcgtcgcgctggtggtgacaccaagattgacttccgcaagcatctggcaccggatgttcgattcctcgacttcgctgccgatatgctttactactgtatctatgacgtaaaggcgaacaccgctgtatggcactggttgcaggaccacgaagattaccaactgtccgaccgagacaactacatcaagaactggttgtcgccgattcagttggagaagaaggttgcagagataatcacctatcaggagcaccgtggcttcgtactgaatgtggacctctgtgagaaggccgtgaaggacttggatgccaagatggaagagcgtcgtgcccgggtagaacctgtgcttcctcctcgtcctgcgactaagaagttcatggctgattacacaccgcctaagcggcagttcaagcagaacggggagatcaccagctacttgcagaagtttattgagcggattggggctcagttgaaagagggtgacgaccggacgatgatcttcgaaggcaaggagtacaagcttccgcttcccgctgacgtaccgctgaagacggaaatgcctgctaagatcggggacacaactcacatcaagcaatggcttatgggtgagtttggttggattccatcagagtggaaagagactgatctgactgtggatcagaagaagatcaagcttccgatggaaaacatcgttgctaagatcgatcgctggctggatgtaacgtatagcacagcgtacaaggaagagcggctggacgggttcggggattacatgaagatcacccctcgtagcacccgcgcgtatgtacgtcagaggttgattgatcgtgcaagcaaggggagctgtaaggttctcactaaccctagcttcacaaagggccaagagaaagaaatgtgtccagacctcgaacgcattgcagaacagtttccgttcgcgaaggatgtgattgagtacctgacctttaagcaccggcgaagcgcaatcctcggtggcggcatggactgggacgaaatggaggatggagaggagccggaaaaaggttaccttgcaagcattcgtcaggacggcaggattcccacgcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatattgcaaatctcttatgatggagaagccatttgacgttcacacaatgatggctaagcgtatttctgagatcattggtcgccaatttaaccgatctcctgcgaaaaacgtaaaatatgggtaagagatcaagcccatgtaaaactgtgtgaattcaggggaagactagaacagtcaatcctgagccaagcctagataccggtagccttcgacagaaggagactactatgggaagatacgcaagagcgggaagatcgcaggctaagatgactgcaaagcctgagaagtacccgcagggcagattcaaggacaaaccgtgccgctggtgcggaaccgtgttcagccccgcagcaccttcgcacttatactgcggagatgactgcaatcagttagcacacgatgatgcacgactcaagaaagcttacggactgacgctaaggcagtacagggcgatggtcgaagagtttgacgagaagtgcaggatatgcggagaagagggattcgagctagtaaaaggtcaacgcctgaagctagtcatagatcactgccacgaaacaggaagggtaagaggtttattatgccacaactgtaatcggggattggggctgtttcaggacagcattcgcaatttgaaatcggctgctgagtatctaggaaggtgcaacgactatcgaaaccacggcgagagccggaagggagtagagtaggatcaagcgatccgaagcgcacagcacgcattgcgtgatgatatagtctggactgcatggggacatgcagcgggagccttgataaagctccggggagggattagcgacccctcctgaacatatcggtacgtacggtgcccaagctggtaaagtggcaaaaaccattggtgccgatttgcaaacgggtcaactggtattcgatgcgttctgggatgcagcattcccattgaaagctctgaaggacgacctcaccaagcaatgggaagccaatggcaagaagtatatcattggagtagacggtcgccgggttcctacccgttcggctcacgctatcctgaacagcttgttccagagtggcggcgttatctgtgctaagcgggctatggtgatccatgatgtactactggagaaagaaggtctgaaggttgactttttcaaagaagactggaagaacaagccggaattctgccaacaaatgatcgcgtaccacgacgaagcgcagttggaagttacagctaagtcggtcagcttcaagatgttcccttggtctcttgtaggcggtaagccagaaggagaaaaggaacaggaggaggcggagaagaagctgaaagctctagctcaggcttacaaggacgaacaattggctagcactggcaaggtgtggagtgatatcgcacactacagcaaaggtgaaggcggggtgtttgtagcttactgccgcgctggagaacttgccacgaaggccgtgagagctgcgggagagttctactctactcctctggtgcctatcgagctgaccgctggctacatcgttggtcgatcttggaaagattgccactaaaactggcattaagcgaggaaaggggcttgacaggcccctccgcctcctatacaatggccacatattcacaacatacaaggagaaacacaatgactctggctttcattatctatctggtaatgaccgtattcccagccttgtcgtcggctggtagctttgccctgatcgtcaccatcatcgcatgggttgcaggagggttcgtttacttggcatccattggtggccgagaaaatgaggcagttaaagctacactcaaaaatcacctccggcccttgacattcaagctgtttctacctatcattgtaatcggccatctagtcccctcgtctgaaacggcatggtggatggttggcgggtacgctgcacagagcctctatcaagcagacgctactcagcaggttctcagcgaatctactgaactgctcgaagctctggttaagcgggctaagaaagaaactctgaaggctgttgaaggcagcagcgagtgatacggtaatcacagaataggaggtatggtatgaacacggctcgactctacgtctacggcaaatcgtccatggtaggaatcactgttgacaacaaggccaatcgggagtactatacctctaaaggcttcgaggtatcggagacaccgttagcccacaaaagcgtggctaacaaatacaaacagaaaggaggtaaataatatgtctggtgttattcccgggactatcgtcaaactcactcaagtgggatgtgacgtcaccgttggctggccaaaggaagcccgatatgtaggcgcatacgcagtcgcagtagatggacgcgatatcggtctcccggaaggggaaatccggttctgctccctccattggtccattgaccgagacgtcaatgatggacttggagactaccaatcgatgctcgctgacaacgaccgcttcgaaattgtagcgatcccgggtaagaagtactatgttaagagcgctgccgagcgcccggacttgatctcccactacttggttacttcggaaccagctttgtacgagggtttcgaaccgtgctggctaaagagcatgctcgaaggagagagcccattctgcatgctctttaaaggacgagttaacatcagcggtgatatttctgacgatccgaagctccagactctctaccctgaattggtacttgaggagttcaaagaagaggcagaggaggctattgaagctccggtcaacgaagagaagaaagaaaaggttgcaaagcccgctgtaatgggttatgctgttctcgatgtagacggattcccgcttaagttcaccattactcgcgaagaggcacggtccactaagcgttggtggggtggcaaggcggaaggcgtctcgattgtcaaactgattaaaggagaggaggtgcgctaatgcgctaatcctcttgcagaatccgggaatgtccggtatgatcgtcggtcaagtggctgacacactcgcccagtctagggtacttaaataggagaaataaaatggcttttaaactgaacgtaactaccaacactcaatccggcaacggcggcatccgcaaggaagtcgattgggatgctctgaacaaccacgtcgtggaagctgctggcactgccgctaaagcacgttcgatcccgggttatatctccggcatcatcgacctcggcgagcaagagcagaacgatgcagaggttgtgttcactggcactgccgaagatgaaatccaaatcatcaaggaatatccgaacacttacttcaaggatggactggacaagcagactcgtaagcctgtacgtctgaagtgctggccgcagcgcgatatgcaacaaatcgcgatcactgtggacttccctcagatcgaggtagacaagagcctgtatctgaccggtaacagcaacaagtctccgcttcgtgtcctgtacaacggcgactttactctgccgggtcagaagactaagattgttggccgtccgttcaccatcaaggaagtgaagcacccgaacggcaaatgggcattcgctaagaactccatgctgcacaaactggctgtagctactggcgtcatcaacgaagacgaactcttcaccaaggaccgcgtaggcgagcttctgggtaaagtggctcagttccaagttcgagtgtggatgaagccgggcaaaaacgacatgaaattcctcaccgaggatattagtctggtcggtatggtgcctgaaggtgttccggttcctgaactggatgagaagtacatctacggcgtgaacctgtatggtgagaacgacgaagaggcagttaagcaactgcgtgccaacgtcatcaacaccatcaagcgagccaagaactacgaaggttctgatatcaaggcgatgatcgaagctgttgaagctgcacgcggtggcaaccgctccagtggggatagcgaggaacaagctgaagctaaagaggagaccaaagctgctcctaaagttgagccggttcagaccaacgtcgatgacgacattccgttctaaggttacgcggaagtagaggtaatagaggggcttcggcccctcctttcaaatttcaaaggaggtaacacatgcaaatcaatctcggtcctatttttcttctggctgccatcattctgtgcgtactgaagtctgccggcgtactcgctatctcttggactctggcgctcatgcccatctggattcctttcgtaatcatgctggttgttcttgtaggttttggcgtggtagctggtgtgctttatgccattgggagccgcagtaaggttaagtacagttttaaaaacaacctccgaaagaagtgaggaccgattatgagcaccctagttattgttcgggtacctgaatacattctaaaaggcccctcagtacacaaccagttcagcggtgaggtgtgggagcgagagcttttcaacgacttgaagaaagctgcgaaaagtatcactaaaggagagccagcgtatgttgctctccctaacaaggtaaaccctgagacccgacaacaagagtgggacattcaggttgtacagttctaacccaaggggagcttcggctccctttttcattggagataaaaaatgagtgaaaaggaagaggatattgtcctcattgacggcgacctgatcgcctttaagtgtgccagtgttaacgagactcgctctatcatcgttaaaaacaaattgacaggggaagaagagacttggaagaatcggacgacttggcgagagaataacaaggacagcgaaggattcgacgaagacaacttcgaaattgaggaccatcaagaccccaagcacgtatcctatggtatctctgttgttaagaccatgatcgaccgaatctgccgccaagctgggtgcaagcagttcaagattctcctatcaggccctgataacttccgtgacgccatcccactcccgaaagaatacgagattaccaagggtaaaaagaccttcactcgtggcggcaggtacaagggtaagcgtacagggcagattaagcctctacagttaggtcagctaaggcagtacatgatcgaagcttatgacaccatcattcaccccggcgaagcggatgatctaatggcagaaatgatgtataagaacggagtgagttactcccgtggagagaccaagcaacgtgttatcggagctaccatcgataaagacgcagacggcactctaggatggctttgcaactatgagagggagcctgttcaggttaagttcatttcaggcctaggatcgctctacagggactctaagggtaaggtgaggggagaggggcgtaagttcttctacttccagcttctattcggagaccctgttgactgctaccgacctgctgacctgtgcatcgggaaggacttcggagaagtggctgcttacaacattataaacccttgtgagtctgataaagagtgctggcaagccatctacgacacctacaaatcttggtatcctgaacctgttacctatacagcttgggatggcaccgagcacacgaaagacgccgtagagatcatgcaaatgtactgtgactgtgcccacatgcaacgctgggcgggagacagagttgactgtagagccgttctagctaaaatgggcgtagagctaggaggtgttgaatgagtgtaaggccgcgcccttgggaggacttcccgggcatctggaaaactgagtcggcgttcttgagttgggtcagaggcggcattcgccgctacctttggtctaagaacccagtcaagcttgagtttgctaaatcccgaagaatcaagatagccaacaccaatgaaaagagcaagctcaggaatcccactgtatggggttatgtatgcgagcagtgtggaaaggaaactcctcaagctaacgtcgagatcgaccacaagacaggagaattctccctgaagcgagtagaggatatccaatcgttcgtggaaggtgttgtgtttgtccgaatggaggacttagctgtactgtgcaaaccgtgccatgagatcaagacctatgcagagcgttatgggctgaccctagaggaagcagatatcgtaaagcaggctattgcaatccagaagcaaaaggggtatgataaggtcttcttgcaggaagtgggaatcaaacccgcatccaacgcagagcttagaaaagagcagatcattgaataccttaggtctaagaaggagggtggatgaacgaggatcgggtttacattgtagtaagagacgaggcaccagagtacatggtgcctactctggttgcacatagcatcctaggggcagacatggcaatggttctcctcggacaggaccgagccgttccatcgacggaccttccgtcccgtccgtatatgcatgcagcggcaaaaaccgccattaagtgggtggagtggaaacagtggagcttccgtaagatcgttgtacgagtttctgacaaagagtacaataagatcaagcaaatccctttcgtatacgaggggtatgagagaaccatctgcaacggagagggctcttgtctagtagtgcctcctcttagcaaggaggagactccgaatgttcttaaatttgcaaaactgtggaggcctatgtgagagagaagcttcttaaaatcatgcgaaagctgccgatcagagtacgagcatctattgctctgatttggatatccgtgttcttctggctcccggttgtaacagcattcgttgcgggtgccgtggacttcttttacactgcaaaagctcagttgaaagagggatactctatcctgcttgatgttgccaagggagcttaccagtgcattaaaacgggagaggagttggagctatgaccagtctagctacatatgttatccgccacaaaaagaccaaagagctttggaccactcctaaaggaaagcggcaatggaccacgaaaggaggggcagcccgagcttggagaaacgcatatgagagtactacactaggagcgtactatgctaaaagagatatggaacggtggcctgacctgaacattcctttgatagtaggggccgctcccgcacgtctggccggctgggaagcagcatcttttaaaaaccaatcagctttcgagattgttgatattgctgaatccctgaagcacgaaagccagttggtgctcgatctactgaaagatgttattgggttcgaagtgccagaccacatcggagacggatatgtccgactcaccattaaaacgtccacatacgacgatatcatcaaactactgaaggaggcaaaatgagcatgactgacccccgagcgtatttcatcaaacaggagctggaggaagcaacgaagcttctagaaagagccctcaaccttctagataacgtccattgctacgatacagatgtatacgaggacattgcagcattcctctacggtcaagagtgcgaggaggaataaggtgcagcgcgatattagtaaaactatagcagaacttcgggacttgatcgaagctgtctctatgctcgacgaggccttggttatgatgcagaaaaacggactatatgatacggacttgtacaaacgtatcgatgcatttttgtattatcaaccgggcgagggcgagtgggaggaagtagaatgagcagcaagaaacactttgtaatctctgatacacaatgcaagccgggtatcagtctggattacatggaagccatcggtaaatatatcgtggcaaaacgtcccgatgttgtgattcacatcggggaccactttgacctagctagcctgtcatcctacgataagggtaagcgctcctctgagggccgtagatacgccgaagacgttcaagtcggacgtgagggtctggatcggctgcttaagcctctgtgggagctacaggagcgtcaacgggctaatcggaagaaggtgtaccaacctcggttgattttcacactgggcaaccacgaagagcgggctgatcgagcagcgaacgataaccctgagttgtatggcaccgtaggcagcgatgagcttggtattcaggactacggttttgaggttgtcccgttcctcaagcctatcgaggtagacggaatctactacgtccactaccttcaaaaccacttcactggtaagcctctgggtggtacagcgaacaacatgctcaaggctgctggtcattcgtttgtcatgggccaccgtcagcttctggactgggcgatccatcctacaatcgacggaaaacaaagacttggcattgtgactggagcgtgttatcctcacgatgaagcctacaaaggctatcagggcaacaaccacttccgtggctgtgttatgattcacgaagtgaaggatggttttggtctacctatgccagtaagtctggacttcatgatggagaaaggaggtttcaaatgacggtttataaattctggtgcgaatgggatatcggtattaatgaatgcctgtggcgagactactaccagatggaagaggatgtagctaaagccttgtcagactgcgggattgaggatactattgaggaactagagggtgcaggcctgcttggcttcgactctgttaaagtgattggttaataggagggcatatggctgagtttttccttggggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggcgctattttcaaaatcgaccgcaaatctaaataatcgaaaaggagatataaaatgactgatttcaacatcacccctgagcaaatggaagaagcaatggcaggtatgaacccggagcagcgggctctggtagagaaagccttgaccgaccgtaaatctctggaagattccatcgtgaccgaggacggtgaactggactatggcatgcttgcacgacacatccgcaccagcttgggtgatctgcctctggtaatgggcggccctgacttcctgaagctgatgatcttggttgctgcgatgccggagaccaaagacgatctcctgactctgcacatgaacctgtccttcattctggactgcattcgtgaatcgattagcgacgaggagtaacaagtggaagagattgtaaaagacgaggctgccctctctggagacgatctcatggttgactcggcagggcttgatgccctgctggcgttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcgacgttcatgctgggcaaccgatttctctggtgcaacggtcaaagaatcctatcaatattcaatattgggacgccgataccatcccttacggcacagtcttggttgttaccgaggaaaggggtgatatacgaaagggagaattggtcgtaaggctggctagtagtgcagatgatgagcactctgtcagggtatgtagattctctgatttcttcctcctaatggagaggggttatgacgcagccagtctcggcgacgttaaacaagcgtatgatgttctgttcgaagatcacccagtgactacctttgttaactgggatcgggctcagcctttgacaaacagtgagcgctactacggagactttctgattggcggcgaccctaaagggatgccactattcaacatggctgttcttaaaaatgttctgtcgccttacactgccgacgatgaggaactttcagctatgtctgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaacaaccccactacgaaggctaacatgccgtattttgcagagtgcaacgatatcatcgaagcgctggatatgcgattcggtcaaggcaacatgttcaaagcgttgtggcgggctgcggcagcacagaacctaggcaagctgaaggccggtaacgatgttatccgggactacgagaaagtcatcttcttcgctcagttggagatcgataagattctcagagaaaggggttgacattctccccgaggcttgcgataataggctccaagttgaaacgaaggaggtatgtagatatgatccagaaagtaaaacagaagcttatgatggtgcatcctatcctcgctagcgagatcgtctggtgcctcaccttcgcaatgcttcagtaaaacaagggagcttcggctccctttattgtatcaggatttaataaggagagtttatgcaaatttctgcaaaagtgattcaacatagctaccggattgggagtggtacgaagaatcacagattcatcactacattcgaactggagtatccccggtttatccatagcgagctaatgactcaccgtctctttagtcgaaatgcagccagcagccgggcaatccctgtagcccatatgatccgccaagtggaagaaaaccctgctatgcctgtccactggggaatgaaccagccgggtatgcaagctgagttcgaattgagtgagtgcttgcagcgtagctctcagtacctgtggaagaaggctgcaaagagtgcagctaggattgctagcgcactaaataaaatgggactccacaagcaggtggttaaccgtctacttgagccgttccaaatgatgaagactgttgttaccgctacggaactggataacttcttctacctgcgttgccataaagacgcacagccggagattaaggttctcgctgagaaaatgtatgaggctcttcttaaagcgggcccggcggaggctctgtatgacggggagtggcatgttccttatgtgactcggttccgcataggttatggtaaactgcgttacgcagattgcaatgggcaagaactaagtgtagaggaggctatcaaggtatccgctagctgctgtgctcaggttagctacaggaagaacgacgagactctggaaaaagctcttgtaatctacaaccgattggtagatactaagcctgttcacgctagtccgttcgaacaccaagctaaaccgatgctggagcctcatttctggtgcggcgattgtcaacaacagccggattgggaggatggcgtaacgcacgcagatcgagagggtaacttctggtctggtaacttcaaaggtttcatccaacatcgtcaactaattgaagggcacgtttgcaacgagttttacggcccagagaaggaaggagtttaaaatggcagaatataacctgagtctggaagacctcatgctggtcgatggcttcaaagaggcgttccagagtaataatgaaaaagtagtacgagagcacctgtggactaacggcatggatgttaaaaactactcttatgaaatggttttctgtcagcatcgcaccctgattggccgggtagtagagggtctacgattctccggctttgagcgtaccgacaaggagtggttgagcctcggctgtgcctcgctggaagctcacatcgcagcgtgtgatgacagcaatctacggttcactcttcgcaaaatgcgtccagagggatcgacagaggcaacgttccacaattaatgcagtaggagtaagtatggaagttacaaaggcgctcgtagatgaggccgatattttcaataagatcacacaaatcaggactccaacggagtcctatgctcggcgttatccggtcattgtcgaactagcaaaccagcaactagaagagaagctgtggttctccagtgaaatgaaggtagagctagacaaacttaacctgaagtttaaattggagcctcaccagcttcacgcagtgaagactgttctccaactgtttctcaaatacgaactgatcgtaggcgaagagttctggatgggtaaagtcgtccgaacgttccctcgtccagaggttaagctagcggcttcgattctgtgcatgatggaactcgctgtgcatgctgagttttacaaccagatcaacgtcgtattgggaatggacacagacgcggactatgtagcttacaaggatgaccctgagcttatgggtcgaatggattggctagaatctgttctaggcgatgaagacgatgttctttcggtcattatcttcagcctcacagagactgccctcctgttcagttccttcgctatcttgaagagtttccagtgcaacgggtacaacgatatccctgtgatcgcacgcggggctaaccagagtgctgtggatgaagacttgcacggtgtagtttcggctgagatcatcaaccaatactacgcagagattggtcgaccattgtctgaagatactcggcgtgtcgagaagattcgacaagctatcgaccatgtatatgctcatgaatgtcgtattgtcgatatggcgatcccgggcggagaacttaacggcgagtcggctgaaaactataaagcgtttgttcgttatcgtttgaacgtatggtgccgtcgtctgggtctggaagatcatttcgagaacgatgacactccgatcaaagattggttcgaaatgaacacgtacgcttacaaaatgattgacttctttactccgggaatgggcatggagtacgaactggggtgggatgaagaggaactagcaaaggcttgggaagaggagctgaaatatgagtaagagagacacattcaactattccgaagctaggaaaaacagtcaagcagcaggagagactcctctgtggtatacgacggctggctaccagttgttcatgaagaaatattcaaatgagggagagtctgttcgctctcgttttgagactgtagccagagctatggctcagcacgcccctacggtgtatcctgagtggtgggacgaggacgaatacactagaggcaaggactgggaacaggtattcttcgacgttatgtgggacggttttgtaagcccatccactccgcttctgtcgaacggtgggctccgcaagaagggcactacggtatcctgtgcaggcgggttgatggacaacaacctctatgaccgttacaatgtaatgacggagattgcagtgctaacgaagcatagtcacggcacaagcttcagcctgaccaactggccatccgaaggcgatgccattcgtggcggagagtcacagggtgttatgcctgtcattcgtgacgttatcaacgtcatggaagaggtcgcacagggttctcgtcgtggtagctgtgcctacagcattaacccccgccacggggacttctggaacgttatcgatcacctgtacaagcgtacagaatcgaacaacgtcggatggttgctggacgacaattggtgcaaggctatggccgagaaagacccggagaccttgaagcgatggaagcgaatgatgttcgtcaagctggccagaggaaaaggctacttcacgtttatcgataagatgaatcggcaccttgcagagccgtttaaacgggcgggtctacgctgtgaagcgtccaacctttgtcaagagactgttctcccggcaaatgactggtatacttttagctgcgttatcctgaactacaacctcgaactttaccgttcttggcctaagcaccttgtgttcatcgggcaggttatgtcggattgcaacatcagcgagtacctcgcaaccatggacgaagttagcattcaggaccgaagggctctggagaagatttaccggttcaccaaggacttccgagcacttggtagcggggttctaggcttccacactctgctccagcgggaacgattcccggttggaagtatggatgcgatgttcctgaacaacgccatcttcaaagggatgaaggagcaagcggaagcttgtaacagttggctagccgaggtgctaggagagccggaggggtgccgtggtctagggaagcgtaacgccactacaatgatgatgccgccaactaaatcgacggctgaactcatggcgggggcctctgagggtatcgggctggacgtggctatgtgcttcacaaagcagagcgctggaggtgaattcttccgtgtcaacaaggtgcttctggagatcatccaagagcgcggactggattgggaagagtgcgctagacagatcaacgaacgtaaggggagtgttcagcacgtagactggttgactgaccacgaaaaggctgtgttccgtactgcctttgaggtgagaatggaagactacctgcgtctgtgctctcagcggcagaagtacatcgaccaaggtcagagcatcaacctgtacttcacgtcgaacgactcgccggcttacatttcgtacatccatcgtctcgccatggaagacccgaacatcctatctctgtactacatctacagtatgagaggagcgggagatatctccagaacagaagaatgtgaaatgtgcatgtaaaatcattggcccggggcttgacagcttccgggcctttgtgtattctgagcacatcaaaacaaggagggactaaaatgaacaaattctctgaagtgtactacacttggagcgcagcgtgctctcgtacaaatatcttgatagatatgggatggactgctacaatccgtcgagacttcactggcgggatcaaccctgtatgggttgtggagttcacgcgatgaacagcaaactccgcaaagagttcgataaatggtggggacaggacgagcaagaagaacttcgtaaatcctgtgccaaaggatgggcggaatatatctggatggctagtcgaagaaaagtgagtgttgagcttcccgcgccagaaggcggatttatcgacatccaaaagtacacaatcaatcgctgcaaagaagctatccgcgaaacaggactggaggtgttttaatgaaagaatattttaaaaagcgactaatgcagaccagtgaaccgttcgactcagcgacgcaagctatggacgtagcgattgcatggggaatggctaagtactgcgaattcacgtgcgttactgctgataatcgcgtcatcagcatctgggagtacaatgacgtagagcctgataagccggtattcaatggacagcaacgaatcttagttccaactttcgaggagggcgtgtaatgaaccagactattgataaatcgcgttatattgtgtttgacaacgaaggtcggcacgttctgaccttgtgcgaggtagctgtctataacctacttaaaggtattcagtggacaaaggatgagcatggtaaaatccacgtaaacggcgtaacaggcgttgaactcggagttcgtcaagggattatcgctgaagtattcctgtatccgggctacatcatcctagaagaggtagactaatggatatgttcgataaatacatgcaagttatgtatgaccgggacgctttctcaaggcgagtcggtgagttagaaaaagaggtagccgaactcaaggctaaggtggctatcgccaagtgtgatatgcgtgtcgtgaaaaccctactggaagatatccaatgggtgtatcaggacgaagctatctatactctaccgggctacgtttgcccttgttgcggggaatctgcaaactatgggcatttccaaggcagcttcgataagggcccctgcctactggcttgtgtactgagccggagtgaagcatatgaagcctaatgttgtagactcgctaggcattaacatgtgctacgcctgcggaggtaagctgtacgtccgaggagtatgcactatctactgccctgattgcgagaaggcagcgaaggataaaccgttcgtcaggatgcagcttctacaggatatcgaagacagcaagagggttgacaacgaatagaagtgctagtaagatggccacatcagacagaggaggagccatggctacaacagagaagatcatcgagtatgtctcggcctgtatcgaacgcttgcaagaggacgtaactgggtactcggagaacttccgtgacagggcactatctaatcgcacagggtatattcacgggcttatcactatggctgaaatgaatgagcaggtgagtatcgaggactgcgacaagctccgtgtaaagcttcgtgaagctgctgaggctgtgttgaacgtactggattccaaaattaactaggaggtgttctgatgaatatgaaagagattgtgcaggctttgattgtcgttgtcgctctgactctcgcagcagtaggttttgtagtcgggattcataaattggccaataagagcgtgcctgccgaggatatcgtcgtatctactgaagacggcactatcaaccttggtagctttgtgaagagcgagaaactgctgtacagcatgtgcatcaaggtggaagaccgtaagccagcttgcgaattcaccaccaaggataaggtagtacatgaagtgcggcaggtgatgcgcccgggcgaggctactgcacgtgacattaagattgcagttaacgcagcagtgacgtatactggagagaatggtcagaaggctacctccctgatccctccgaaaggtgaattcctgccggcaggtactccgtcagaggtgcatatcgaaacgattgaccgcttgttcgacagcgtgtataatgactacaagcaaaacttcagcaagatgtgaggaggactcatgaaagcacagcctaaagaagtagaaactctatccctcgataagcgacccaaggcaggtgatgttgttcgactgcggtctgacggtaaaacctacgaggtaaatgctgtatatcccacggcagtaggctgggaagcggttctacgcaacatgtacgacaagactaagaccgtcactgttagcatggagtggtgaaatggcaagaaccggcaagtgcgtaaacttcctacctgtcacgccggacgggcgagtaatcgtccgattcggcaagaaaaggctaggctggctcggtaaagagggtaaaaagtggtattactacccttatggatgtgaaggtaagattaaatcagaggggtttaagacgctcgctgaaatcaaggcttggattcgagaccccgatgctgtctggcccggtccaaagcctgagattgactaattagccgacgaatggtacaatggtatgtaggaaattccctactcaatataaggaaactagcaatgactagccgctggaaagaggccgtgtatcgtaagtactcggtgcgtcgtctgcggcaggaactcgaagagttcaaagaagctagacgctttgcaccaaaccaacgcatccgtgcatggtttgatgctcatatcgaatttctagaacgccacttggctattcgagagtccggccaagcctacccagacgacctttggtaattaggtaattaggtgtgttgtaggtagagattcaaatcatggttagtggcaaggacgccacacttcagcccgcccacaaggcgggcttctttttgcctgaaatttgcggttgacaaggttggccggaatatgtaaacttacggcatccaacagaggagggaagaaaaatgcaattcaatatatcgaagcaactatgggtagctaaaagcgagcggaagggcgactataaagggacgcttttggcatacatgtctcaagtggacttcaataaagatggtagcttggctgccagcttcaagaaaaagcagcagactggtatgagctgggcaggtaagaatgccgagacttgcttcatagacaacatccctatctcggggcatttcatcggggacagtgttgaacgctgggtcactgagaacaaatatttccgtgtgacggaccctaggggctttgttctagaggttcctaccgggaacatctcgaccctactattcaactgcactgtaatcaagggagtcattcaagagccttgtgtgtgggttcgtatgggttctcagcacgttctattgccggaaggttcctctctctacaaagaggctgtaagcttcgtggagcgaaaagagtcggccaaaactgttaaagatatggttgcaggggatcgatgcactcttcttagctacgggacagaggagaaactagaggctatctacctcggacaggtgaagatcacttggcacctcctagctaaaaagggccggtactctagccgagggtggggtggaggtcggtggggttaccaccatctagagagggaactagatagaaaagaattcactgagaaagattcgaagtgggttagtgtgttcgctaagccggtaggaaagcggtggagtatccattttatcctgtctccaaaggcaaccgacattcaatctggaaatgtaccggatgaacttcaaaacctcgacctagtgaatggtgtaaaatgggagtacaacgagaaagacgaccgcccatcttcctattactctgtaccggatagggtagttaagtgtatcagtgtggatgatcccctgtgggataagctgcacagctcttcggaggtgcggtggacccgcgaatggaccgtggtcggagcagagtggcgaaaataagccaccattattttagaattgcccggcgagagccgggcttttcatggcatgggttattttcaaattatttttagatttctgggagtttcggccaatatgggcaatatgaaatttctcaggaaaaggctcagaatgctcgtataagagccgttcgagtgtaggtatggtgagctactacttagccgtagaaggacagtgtaacgcttaataggagggttagaatgaagattgacaacggtgccgagtatgagcattggctagcgaataccaaggagtttgtttctcagatggatgccacagagatcgagaaggcggcttgtatagcatacttagttagctggtatcagaggagagtactacacaggattaaacgggaggaatatgaggcgatctaatctagggaccgggcagatttttagggactggatagatttttacaggctgcaaaattaggaactgggcagatttttaggaactggacagtttttcacagaaggggatttttctacagaggaatttcccctgaaatttagccggatttctcagaagggcggatcgttagcaggctatctaattggttagcaagctacctttaatcgttagcacactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgcgcccattctactatgacaaacccctttgtcaacataattttatggcacagtctttgcaattgcaattagcgtgccaatctaaatctcaggctccctccgtgtttgcctccggtgctcggcctcctgcctgcgttgcccgcctgcctgtcattatacacaagctatcaagacaagcaagaaaaattatagagaaaaatctacataaaacaggttgacaggcctcctttatatatgcacaatgggcgcacattcaacggaacggcaggtaaatagccatgctacatagtgaagcccgggagatcgcactacaggaaatggataagtggagcctccttgagcaaggttggaaattctcgttcaaccgtaggttgaaaaggactctaggtcgatgcaatcatgctaagaagctcatagagctaggttacgattatgtagctgacaatgggcttcccgcagtgttggataccatccgacacgaaatagcccatgctaaggcgggcccgcaacagggccacggatttatatggaaagagtggtgcggattgatcggggctaaacctcagcagtacgccagcacaaaggaaaaagtagtcacctttcctttgaggctagccatcctacacgaagatggcacgttagagccgctgaatcattttggtttcaggcggaccaacatggcgagaaaacaggtgcgcgggcgtcctgagacgctgggcaggctagtttgggtgaagaacgaaaataattgagaaaaagatgttgacagcttgggccattcctgtagaatggccatcaagcaagacaaacaacctgtaggagctacaaatgcaagcttggaacgtataccagaacggtcaactgatcgatactgttttcttcgatatcatgcgtgctgccgaagaggtgcggaaatcactggtcaaccatgacgggtatccgtccgatattactgtagaggaggtagagtaatggatagcttgtcagttaagattgttctgtcggaactcagctacaaagctttgactcaagccttcgcattgcttggccgggtgctcgatctggatgaggggttagatgatatacttaacctcatcgccgatgaaattgctttccgcgacggccttccgcctttcgaagacggatgtgataaaacagaatggatgctccggcgatgggaatcgctcccggtggtatcgtataacgccgggcaagacgggccggctgtcgctcgatctatcgaagtaaagcccgcatagtgggcaaactgatgactattaaagtagaggatatcgtagctatccggggcgatcttcggaaaaagctcgacggatcgtgccagtatctacctgaacagctagtagacggtaaatttctcaagcataccggtacgggagaaatgtggactggcagagtggaacggatacaaggcgatgtagccaaggtaggcggtggctggcgtggcattgaatcttatgttcccattagtgaaataaacgcttgacaacctgacccactagctgcaaaatagcacccacagacaacgaagacaacgaagacgccgataggcgaggagaaagcagatgaaaatgtttttcaaaacccgtacccaagcccgtgcaatggccaccaatggccgtaaagtggtagacaacggcgctcaagctgaaaagcgctgggctgtcaagctgaacaaaaaggaggcgaagtaatggctaagtctgttagtgtagatcgcaagcgttccatcctcgacgaagcgaaggacggcagtttcttcagtgtggagttcatcaaggcagacggcaccgtccgaaagatgacgtgcaagcgccagattaaatcggcatacgccaacggccagtacgccactcgcaaaccgaccagcgccggcaagccgcacctgtataccgctgctgaagtgctgaacatggaagagggtaaatccgctttccgtactattaatctcgaaaccctcgtccgtgcgaaggtgaacggaatcgaatataaattcgattaaagggttgacagcttaggccattcctgtagaatggccctcaagcaagacaaacaactgagaggcggcaacatgaaacaaggtactgatttgatcgctaaagtaaatttcaccgcccggctcccgggagctaagcgggggatttcggtcaagccgggagataaattctgggtcactactccatcctacagtaacgccgatttcgtaggcgtagcgaggaaaggcaaaacaacctcctatctttttactgctaaggatgtacaaactctcttcgaaacggtataatcttcagacccaattaaccaacgtttgacaacataggagatttaaaatggcacgttctatcaaggcttccgacttcgattcctcttaccagttcgaggccgccaaacgttccgaacgtaaagagtcccgcaaatcgcgtgacaatcgcaaagcgagccgaggccgagctttcgacttccgcgacgatatctaagatttgcgcctagccggtgggccgattcgccggcaatcctaagcccattcgtcgagtggtttttaggattctcaaccccagcggagataccaaaaatggttcgtcaatgcgtaccctgtcccgatgctcgccatgctttttgccttgcatggttgttcgccatgccggagttcgccggtctgcctgctcaaaaggacataaaactctttaagacttcgggacagtgggcggtatgttatggctagacggcagcggctcccgtcgtgggttcaagaccagaccgaggatgaaacgccgctgagggataagatagacccataccttagcaagctcggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacaaggttcccgcctcctgtagaatggtcagcaagaaaggcggacaggccgcctagctagacaaaggacaatcgtcatgcacttcactctcaatctcgtttccaaaaacagcaaaaccggtcccatgcctgttagcacgtctcataacggcacctgcccggatgcttgtcctctcaaggctaaaggctgctatgccgcttatgggcctactgctattcactggaaaaagctaagcaagggtgaacgtggcgtagagtggaaagagttccttaagcaagtgcggtctatctcccgtggggatttgtggcgtcataatcaagctggcgatctcgtgggtcatgatgacgttatcgatgggatcgccctgatggaactggtgaaggctaacaaaggacgtcgcggcttcacctatacgcactacccgatgaacgatttcatgaaccgccagcacgtattgtcggccaatcgtagcgggtttactatcaacctgtcgggcaacaatgtagcgcacgccgatgaactggccgacctgaacatcgctcctgtagtgactattctcccgatggacgcggagaatgtaagctttacgccgaaaggacgtaaagtagtagcttgtccggctgagaaaagcgacaaggtgaattgtaagtcgtgcggcttgtgccaagtggccgaccgggagtatattatcggcttccgtgcccacggcacagcaaagaaaactgtcgatctcattgctaagggttaacacaatggacgaatctgtttacgcaccattcaatcagtgtaagatgatgggcctagaacgaaccgtgcggagcctagcggctcctaacgggtgcaaggtagtcttgtatcaggaccataagaacaagcatagaatcgtcatatacgatgccttagggcatggaatgtctggggtcatggtgcaagcggatggggaaattcactacaaggaaacccgcaaggctagccaagggcaaaacctgacaaggcaactacaagcccaactgaccgcatggggagtgaagtggtttccctctcagtatcagacaacggcaggcgcagcttgctacaaaggagaccggtaatgcgacagcttaacaaaactcaattcaaagcattaggcgctaagatcgacctagccttagagctagccgctactggtcgaggtgaactaatgaatggctacggctctacctgctacatttcaaacaaggctggccataatatccttcgagtgagctaccataactcccgattcgttgtgtacggtaacgagagcgtccgggttaccgggaccgccttgcaggcttggatggagtggaaaggcattaatctggcagccatcgcgtctgttagtgagtatgggtatcatcctaacctgagcatcggtcacaatgacgctcttaagactctcaaggctattgagagctaccaacgggagcccgtccagtgacggcctcctactccgtagacaagctgggacagcgctgggctgttatccgaacggaactcagctttcgaggtgaaagagtcaccgtgatggggttttgtgtagaccgggcccatgctctgaaaacggtagccaaattcaaagcttggcaagcgcaaggctggccctacactctgaaagacgacagaaaaataaagcttgacagcttaggccattcctgtagaatggccctcaagcaagacaaaccggccatcaggaggctagaaaaatgaaagctgtagctcagttcaaaagtgaagattacgcaagcggtgatagccgcaccgctaccgtctatgaagacgtctatggctgctacatcgtgagcgttttcggaactagcttgagcgagcccattgccttccattggggcccgttcgaggataaagaatccgcaatcgatggcgctaagtctgctatctaataaaaagggactacagaatgaaaatctccgctatcctgaaaaataaccttgaaatctacgggccgacggatttcatgtgtaccttgatagactatgatccgaccctaggggaagaggaggcgatcgaggctaggcggtttatcgccaacttgctagatggattcatcactctgcacactaagctcaggggtgaattaccagaatatgacgtcgcctatagcgtcaatggcggtttcgggtctaacaagtgttttcaaatgcgacgcttgtggtgggaaactgtaatcgaacaacttgaggctcaagggaaatgacccaagctaactggtgcaaaggcgtccgtatacttggcgggaagcgggacggcgagaccgtcctgttcaccgacgctcacttcagcgagtcgatgggtatggcaggcggcgaccctgaactggtggaagctctgcccatgcctgcggctcttcgtctgctggtcaaatggaacaaactgtgcaaacaaatgaagcttgattaccggtacgaactgctgtaagctatagtctcaatcaagacaggaatgaaccaatgtcgattctagctctaaccctgaccctctgctctgctgtccagtgcgatgattacattatcgatcacactttgccgggacaagccgcagaatgtaatgctcggctggtggaagaggccgaggagtggggcgatgcttgggtatcaactaacgctgatgcccgtctgacccgctatcttagccgattcaatattcaggttgacccgcgctttgttttcgattacgatttcacctgtcaactgatcgcagaggatgaactgccatgatcgctccacgtatcaccaataaacagacccagcgccgagccgccatcatcattcgccgagtgaaatactacgaaagccgctggcttcgaacggtgactttcttcgtaggagcggccagcgagaatataaccgaacgtttcgcctatctgcggcacgcagaagagcaaatgtccaagctgaaagctgagtttgcagcttttccggtagagcatcggttgaaggctctcggttggatcaactggaatacctacaatgatggcctactagaggagtggattcacccggacagtgaccgagccatcatgctagagtatgacagcacaacttggcggccagaggcttgctgggaaaccaaggttgactcactctcgaaactagcaatgctgtaaaataatgcccgttaggctgaaataatgcttgacgggcgtttttgtatctgtaaaatagtcctcaagaaaggaaaacagccgaaaggctcaatctgaaacccggagatcgacaaaatgctgctagttcacggcaccactgagaaaggcctgaaagctatcatgaaccgccaaggcaaggatggattggccgcgccttgggatgtttcggatcacgacggcatgacctacttccacgacgtgaacaaggctatggaatggatggctaacgaagaagaagctgagctagattgcgtttaccgttgcctatcgcaagcccaattacagcaggctatgatggccgaaggaggtaaaatctatgctcttgtggtagatatccccgaagagtttgaacatagcgtagaagacgactattcttgccctaacatggcagattcggccagttgtattcccgaagataagttcgacccagcttggattgtcagagtgtacgaatcctcggttaacgtgtgggcaattccgttcattgtgtcggggatactcggcaatcctatgtttcaatcctaccgcctgcctgaaaatttgctggcagtagctgaagcggtatctaaggcggacgcctactgtgaggatattatggaaatcgactatgacgagcagccgctcagcattctggaagatttcaaagagaacgcttgacagactgatatggaagcgtagaatgtcagccagaggggagcataaagcttccctaagaggatatgagaatgagcatcatagatcgcaccgaggggaacgaaagccccaaccattgctacattgtgactggcagcattggccccgagttcgaacccctgctattcgctactcatacattggcaaagaagtatgcccagcatatagtgaaatacggcaaggcgaacgatgttttccctcctttcgtgcctgttatcgagactcgccacaaggcagatatgaaccgcttcacgatccacaacaaaatcccggaataggagataaatcgttgaaactctctcaaattttccaagaaggcctcgactacgctatctttcacggaacgccgtggtatatgtgtgtacgtctccgggaactggacttgccaattaatctcgacgacgtgacccgggacattcgatctatcatgaatgaagccggaatgacccggcagtttatcggcgacagttgggatggcggcgtggacgaccacttttgggaaactggcatggctgatgcttatgtgatgacgtggcaagagactatcgattacgggagccccgcctatgcaatgtgggtgcaattttggttcttcgtaatctttgacttagcccgaaaagggcagtagaatagccggcagataatgtgatctaagggacgatcatgaaagacaagactgtagtttatcgaatcgagtgcaataacggcgagggcccttatgttaatgggtgcatgacgaattcgtcttccactccagaacggcctgtccctgagcacgacgggataccggatgttcgcgattttgagttcttcgccttcacgtcccctaggcagctagacgattggtttggcgacgaatacgatgtactatctttctattctaccgcacggatcagggtctatgcggtggacaagcaacatgtaagggtcggcatccggcaatgtgtattccgcaaggcggaagctgattgcgtccaagaggtgagcatagaccaatgggttagcatggtgaaggctggaatgctttctgccgtcgtcgcacaagctctatctccggtcccgcctgagcagctatccctagacctagagggcgatccgtcctgcacagcttcgaaagaaattttgaaaatgttcggtttatagggttgacagcttgagtcattcgcgtagaatggccctcaagcaagacaaaccacaaacccggagattcaccatgaacactttcgcatacgctcacttcgtagcacgtcaagacaaagctagcggcactagcttgccctacgcaacgctgtttcgaatcgcccttcggatggcctatcgccagcccggcgtccggcagtatgactactcctctcttgtcgaggacgtcaagcgccgcgaactgatccaaaagcgcattcgtgctgaaaagtccgtcgttatggccgctgttatgcgtgcaatccgtactggcttcactgttagcgtgaaagatggcagcgatggcgagtgggtagtgaaaaagtctaccgatatcaaggaaatctccgacagcctgcaatctaccgacgaggatatcatccgcttccgcaagggcgacggcccggataacatcgtcggctctatgtgggcgatctacggtaacagcgccagcgaagtgatcgccgactggaccgaaaatgccaccatggccatgattatggctcccgcagaacgtaagatggaaaaatacgctgaaattgggatttaatgcttgacggggcccgaaaagggccccataatgcacccataccaaccaagcaatctagagggcaacaccatggctacactgattatcggcaacgtaaactaccataaccatcgtctagtcgatgaaatcgctggcgatgctggctacaagggtgccgcccgcttggtggacgaatgcactcgcaaaatcaccttgctagcgccttctggaatttctgccatcgacgccaaggagcgtgctgaagtcgccgcaatgattggtgagtatcttctggcaggattcgaagtttcgattcagcactaacaccttaaacccggagtactgacaatgaaacgccaatataccgactcttaccagtgcaaagcaatcgacggcatgatctctatcctcggcagcaagaaagttaccactcaagtgccgccgtcgatgaaagcctctcgaaataaactgctgaaaaagatgataaaatacgtcgcccgggcaggatggaaaccgtaatcgactaattatcacagccccggcgagccggggctcacaataggagatagaaagcatgaataccctgattatccgcttggattccgcctatagcgttcaaactgtccgtagcttccttgtggaggctgtagaaagtattcagaatcatatccgcgactatgcgacgcatactgagtacgattcaggcttgagcccggtagcacacaatcaccgtctcgcaatcgtcaccttggacgaagattgccgagtgtttcacattcaatgcgagtcacccgatctttatctggctgaccctcgaatcgtgtttactgatgttgaaagcccggcatataccactcccgtgaacgagatcgaagagtatagttacatgaccgcatggcagcatatccgccaaaaagatatgacagcaaaagaccgcctgtcaggttgggcgatccttttcgcctcgaaagagaatgccattgatatcgacccgcgccccaatctgaaaacgcaaatcttgcattaaccgaggagggtcatcaaatgaataacaagtataaggataacatcattgcggaatactgccatttcgacggcagacggccagtcctttccttggcggcacgatgggtccactacgacagtcgcgttgtgaagctggcagcgctctttgcctgtgctggctatggccgtccttacaaagattgtattcgtgcctacaaggacgccaagcagcgggaaaaggatatgcgaaaccctgccaaatggaagctgagccgagcgactaagcgggctctacgggcccggctggcgtccaaaaagaaactcaaataaactgttgacagcttgggccattcctgtagaatggccatcaagcaaggggatgagccctaagcagtagaagaggtgagaacgatgcaagcgacctaccaagccctgaaaaccctccgcgatgcttgcgaagctgccaaggatgaaaaaggcaccatcaacggaaacaagctgaactcgcttcgcaataaggctgtcaaggaaatgcaagctggcggcgaaacctactctgatgctatcgccatggcccacgacttgattaagaaataccgcaagtaatcaatccgtaacaagccccgggtgaccggggcctctcataggaaagaccatgaaaaacgttcaaatctgttgttcgaagtgtggagccatcaacggcggtaacagcaaacacaattgggttatcgcattaggcaagaagtggtgcggtcattgtgggtctaatctcgcaacccttcgtcgctaaccattcactgagacctaatcgaggagagatcatgaacgccactctggcacgcctacagaacgaacgctgtgcaaccctccgcctgatgctgctgccggaacatcgtggataccagttcactggccatccttgggccgagcgaatccgcaatctccacgatgaagctcggtgcatccgcagccatcacagctaaccccattcccagcccggcacagccgggctttctctcataggaggcaagtgaacaatggttaactatctgatcctctttttcgtcatagcaatggtctattgcgtgataggcgctttagtctctggaatgctactaatgctaaaagaggctagctccgacctaaaagagcctacccgcaaggagaaagatgttatctatgtcctaggtgcaatctggcctatctcattaccatttatcgcagtaggtattgtcctaggcctaccggccatggtgatcgtaaaggcagtgaaacgcctaatcaaaaacgactactaagcccactaaaaccaacaaagctctaacagcccgccttgtgcgggctttgttctatctgcgaaagcggagctttcaagtgtaattaacatgtaatgttgtaacaccctgtagagggtaacaccagcatgacaagatagaccacttgtaacgttaacgttacatgtataacagcatgacagcggaagctgtatgttcacattctgtatagataaccctatcaaataaccccacaataacctacctaaaacctaccggtttaaagcggcctaataggccgtagatgaagcgatagcttcgctatgttagtctgcaccgtcaaggcgaaagccttacagcatgaggcttgtaggaggttttagaggcatatgcgattagcataggatgttggttgttttgagtagatttttggtataacccctttccgcgctaccattgtcccgttgatgttaacgtttacccgattgtgttaagcgacagcttacacccgctctcattttgcaatgagaattgcgtacagttcatcatgcgcctcagaagtgacttcactttgcatgcggatgcatgctatagtataccctgtgatagctccgctatcccgttttgcatggcacaggaattgcataagcatgacaagggtaaccctcgaaagcggagctttcaaagtgtagtctctacctctattatatttgcgactcaatttcgcgacaccagaaaacttgactcaagcccagtaaatacgttagactaaaatgtggatagctcccgctatcaatagatcaaaattcacacaaggagacccaatgacaagcaacattcatgccaataatgcccgctcacctatcggtgaagaaatgcacatccattacgctaaaggcgtattccatgccatgcgacagcgatgcaatcccaaggaccgaatctataccggggcttcgctctgcgaggagtggtctaagcctagagcagccggattcgaatcgttctatgaatgggcggtctatgaggctggttactcagatggctaccaactggacaaggacattctattcccgggaaacaatctgtatgctccgcatacgtgtgcgttcattccgcaatacatgaacaaactcttcacaaactgcggcggcactaagcgagtccatgcaaaacccaagccagctagaacgctcccgctaggcgtgcagataaactactacagaaagaacggtaacccatcctacacttcgcaatgccgatccctaggcaagcaggcgacactaggttcgttccgaaccgcaatggaggcacacgttgcttggcaacatgccaagatagcagccatccatgaatgtatcgatctctatcagatggaagacgttcacagtgtggatatcatccaagccttgcttggaagggtagaccaattgtggaaggatatagatgcgggcagggagaccattttgttgcaatagcatcccatgggccagcggctacccgtccagagtgcgagtaatccgatagcgaagctatcaaatgtatatgcatattccatgccaacatgtggaaagattttacccggcagggcgggagcccgttggcattagttttgcatagcttagctgtcgctaagaaggaaagaccacggccgcccattattttggatttactaagggttagggtagcgaggtgggttcgtggttaagtagctcggaaataaatccataactggcagaaggcgaaccagcagagggcaggcccgctccctccattattttcccagcagtagaggagacacactctacaaacgtatcactctcttcggcggggggtttaggattcgaatatacctttagcggctaaatgccatcattgcttatttcctattttcgtgctataatccttataggatgttcttattcttcattatagctggataagcgatggttgtatagattcaccacaaatagaaggaatatagaatggaagataatattcaagctccgcttgcagctagtgcaggtggcaaattcgcaactgtatacgaagctattgtcgcactcggagtagaaggggctgccgctgtgtacagggtaggtgtagggaatagattgacaacagctagaccatcggcgtggtaaagaggagccccgggcagcgaaagctgatcccggggctttttattgccttgagtttatgtatgaagagattccagttgtctctgctcttccatatactccctagtggcgtagttaatcatgaggttgcaatactcttcgtttatctggtccatgtattgcaacactttctccatgctctggcacggactgaatccgttatgacggagaatcttgtttagattttcacttccccagaagtctctggcccaagcctccaaagctactgcgtagaggcttttgatgcacccgataggggctggataccaatattgctcagacattagaccctcccgaacgttacgatcacgccttgcttggctagggttgcttgtagctcatccagtgagaggggcttaccgcccacgatgacatacttatctgcctctcctagagtcatcacacacttagtctggaaggtaggcctatacaaggcgtacatatcgggttgccacttgcttcgcaggcctgttccgtagctaatgaaccggtcttcggaatgatcccggatgtacaggcaccggggactatcgtctggcccatctacggagatagggtgttccatccactccctgatcttatcaacgacgccctctcctaccttcaattgagcgtcctgacagtactcaaggaacgcatcaaactgttcggcagtgaaattgctgacatcgatctctttagttttcattctcttcctccatgtctgcaatgatttccttcaacgcttgaagcgtgtaggtgccatttagctctgtagtaggaccagtgtcacactcatgaagtgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatctccaacccacagtagcacttgagccttgtcgtacatgaagccgtttccgctcccaaactcgataccataagccttaaggtgctgttgtactgcaatgttctcttcgggggtcttcacaatagtgtaaaacttcaccaaacgctctttcaattgtattcctcctgtctgtgtttttatgggagtgtaaaacgttcccagtccattgtcaagccttctgtggtgatagtctgttccagacgctctctagctccttttagaatgatatcccactcatctccttcttggacccctacatacttctccatcatcagcgcacgatcaacaagcccagctctgtagttctgtcgctcttttctacgcgatagcactcttgagatatggtccttcttctttgccaacacgctgatagctttccttgccataagagttgcatactcgcgttcctcagtagtcatccattcctgatacagcagccctagacgagtatcatgctgtaggagtggaaggtctttccatatgatccctactcgtccagtatcagagactgctttccattccagcgtagtgccggtcttacagtcggtgatctttacattctccgagttagattgagactggaaagcgtgcctccagtctcggtatacagtccaccgtttccagtcgaagaatgtctcacagatggctttaacaggttctccgattttaccctccagttctttcaggcggttctcctgctcagcactcatgtatttgataggtcgggaggcggggtcgtagcactcctcgacccgggcctccagtagtttaggctcctcgttccgctcttcctctcggaaccatgcgaacagcttcttaaacatattcagtcctcctctcctgtgatagctaccctagtcagtctccacacttttctaggtagactaacgaggaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatactagaatgagaagccctacttgttccatggtgcgatcctcttaagtagtttacggctgttccagatagacagagcccacttaggtaacaacaccactttcaaaacgctgtatgttgcgtagagtagcagaaagctagcatacactgtgaatgtaataggccatagcagtcccagtacaatggcaaaagcctcgataccctctctgtgatctttagtcgcactagctgggaagttatctttgaaatactccgtgatacccatgtaggtccacatgaacacaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtcccacgtctgagacggtgacgctggagtcactgcacagtgccaatctctccagaatgtagcacatgtaaggctcttcttcgttctctaagaatgcccgcatgccctccttgattagcggtgcaatagaattagagttcattgttttcctcctttgagagccccactagggctctaaatttttggttcgacctccggtcaacacatcacaacccagttgtacaggtccgcctcctcataagcggatgggtaacgattgtactccaagaagaacgcatggtcaatagctgagtatttggttgcgaagctgtcgatgtacgttataaatccgttatcgcctcgcctgaacagaacgtattcttcagtgccgtccttgaacgtatccaacgagataatatacttgtcgaagatcacagcatttcctcccggctgatgtagtagttgtagtcgtcctcttggacgaggaacgcacggtagaagcctttctcaaagtctcctttcactagcaccagattgccttccaccttgcaggtgtagatgtacatggtgttcgctactcggataacaggatcatccccgggacgaacatccagagcagagagcatagcctccattggcatgcttgtcaagtgtgcaactacagccgagcagtattctgcatcgcggccagaagtgtcctctgcataagcaggagcgaccccgcacgaatgcagggcgagtgtaaacgcaatagctacgagtttcttgaacatactaaccctcctcttggtctgtctggggaacatccggcttggggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaagacttgcaaaaattgtcaagagcttttttgcagaaagaggaatcgacctttcatcgggtctgtaccagtccagccgggcaactccttggagaacgtcgtctacccacaacgggtagtctccgtctagctcgaccatgacttcgtacatttcaggctgaacagcgttgaaaaagaaagagggctttcgccctctgctggtatctagaggaggaacaagccccctctccaccttgtgaatcaaccgatcagcattcgcccctatccgagactttagctcctcgatctcttcacatgtcaacatacggagggcacaccttagatttctcgatagtgaacacgccttcgcatgtcaggttagcaggtccataccacttgaacatgttgttgatatcgtatcgaatcaactggcggaacttctgcccgtcgcacatatccacgtcgaaccacgccacgacccatctgacgtaatcttcagggtcgttctcttctcgccatctgcactctagatcaacgtgactgggctctagaacgtaaatgtcttcgaaccctgtactctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctgtctctgtctgcatggcggtacagattgaagcaaggcacgcctctagaggacgccagttgccaagcggtcctagtcccgccttctggaatcccgttgtggtctgtcttgctccagcacaccaagaacttgctaggcgtgttgagatcgattcccagcacttggaaaacgttccgagtgtgggctcgtcttgcgaacgggcttagaacgggttccccgtcatttctgacagaattccaagctgggtggatttgactggcaatgcttctagcttcttcccattcatctggcaactcttcctctggcaggatggtagctccaagcgtctccgttatctggtactgattgaagccgggagacggaagatagatttctgccatagtccctcccttgttattggatatataatccagccagcccgattcgaacgctgagtccgctcccttcgctcctcctgaccgaagaataaaaccttgttctgccagtttacggcctacctctcggaggataccccattctctgttaggagtgtccctgctcccgactcctgtataatatctcatcgtctcaccatttgtcccagttctccgtatgtaatccagtggtgacgataatccccttcttggttggtgtactccactaacaccggatagaagttgtcttcgtggtctatgcctaccaccttgcattcacatcctctgggaatagtgtatccatcactgcccatggttaagagcattccccggtacacgtcttttatctctagctcaccttctccagactcttcaaacttgagtctcaatttctcgattatttgagcttgcaaatagagaagttcgtacgctgttaagttgtccagatcaatagacatgtcactccctcccttctagtttcttgaatgccttgtccagcttggctagatgcttatccaacttgtctagctttttatcctgataaagctggaacgcctccgagcccggggccaaccaagtccccttatacttaattgcaccccggatcatatctcctcctattacagttcgtaaacgtatacctgaaactggccgagtgtctcctcgataagaggctcgacattgctccagtcctctccggctaaaccgcatccaatcttcggcagacctacacacaactccgaggtaggaatcgcccgagcgtcagcctctgcctcaaggaacagagacatagtgtacagggcttggcccagtgcgtcaagctgagtgtagactcgtccctcttctcggccatagttgtactgcccgtacagattgtaaatcgatccatactcgttaattgtgaaggtgagggagccgagtttacctcgatcccctttcaccgttgcttggtctgcctcgtaggcctccgggaattgctcccggatttgcttagcaatgccgctgcccatggtgttgaagcaattagcctgatgtgcaatagcgtgcaactctttgtttttgaacgctgcgataagatcgccctttcggtatttaatcatttgaacctctctacacttgtgaacctgacttcagcgcctctcgctccgtgagcaatgtccgagtacatcgagttcatggccgcaaacggagaccaatactccttctcccagattctgaacttgaacaatttgtgccctttgttttctgggcgtccttgctcgcagaaggttgtaaaatagtatttagccaccacctctcctccttatacgccgttcttaatccggtagcggatcgactctagatcattattcttcaggtcttcggtgttccattttccgtctttgaagaacgtcctcaagtgcccagtctcttcctcttccttcgttacattgtctttcagtcggaggaaccgtccgttctcttggtctcggtacactttcaagagacctttagccgacttcttcttgctgtcagttttcgggtctttgaagatcgcgataccttcaccattcacttcggtgtaggtggctttcactgcaaatccgaaagtatcccgggtgttgcactgataggtgtagctaccaactccgaacactacgttcagggaagcaaaacctttctccttcaagcgctccaagattttagctgctcggcgagttgtaatggaatccccatagatcaatccgatatgagaatcgagcatcttataacctgcctcgttcacagtacctccgaaggtttcccacagaacttggatggctcctttcacctgtgcctcgctcacttcttcgagtttatagccaactacatactcgtattggtcccattcggtgggaataaccttgaagtacttatcttcaaagttcagaacaaaggcgtcgtttccattaactgcatccatgatatcccagtgttcgagagattcaacaacttcaatatcgcctagtccacagataacctctacagggtcaccagaatcagggcgaacaaccagcttgccatcccgctccatgatctgatccttgatggacggcagaatgtcagtaatcacgccccagaagtcgaagctgtctgccacgtacgacagaataccactcgggaacttacccatcagttcgacaaggaaccgacgttctgcttcctcacggccaccttcaccttccccatcattcatttctttctcaatacgaaggatgttgctagtagctacagcgtgttcagtcgcaggtacggagcaagctaccagaccagtcgcgctatagtaatcctcagcataaatagctgctgccaaggtgtccgagcctacgaacgaggtcaagtgaccaacaccacttcgggccgcgtcttcaatcccactcataccccgggcactgaagtcgtgaaactgaacggacagcaggaagtcgtcgtagcacccagtgtggttcgcgtagtaccggcccatagctgcgtattctgcggcaatggttgcgttggttgcggtcttccaagtcatagccgaaatcagggtctcatggtagttcaccagccagtagaactcaggcagggtattcttgatagtgagcacaggcacgcccataggaacgctaacgccctcggtcaaagacttaacctccagaggcagatagccgagcttgtgaagggcgcgaagctgctccacggcttccatttcccggccaaaatagccagtcaggaaccgggaataccggccaacggcgttctcttcttcagccgcgaagaagccttcccaagactctacgatctccatccaagcggcccgtccgccgacccacttgagagtgccgtcgtagaagtcggtggcatgcgtctttcgataaatcttatcggagcgaggggtcaggttactatagacaagctgagtcccttccgagtacatggaaccgtgtccaatcttataaccatcggtggaaagatgtggcagaattttcatgttatttcctcctgttgtgttgaataggcccagactacatcaatctgggcctcctgtcaatattcgacttcttctactggcagcgtcagcacagggtagatgcatggaaggcgcagcaatggttgcttcttgctgtggaagtcttcccaaaacttatcgtgcatcatcttgtaccgagcgtccagttcctccttggtgtcgaactcctccaccttgacaaccctcttctctggagccgaacgcttatactctacaatccagatactcaagctcacaggcgttccgccttggagtattcaaccggaatgacagtcagcgcttcgtgctctttttgagggagcgtatccgaggtgtagatgcatccgaaggaatccagcaagcagtcgatacccttactgaagattccatgagtgacgaacaggtcagggagcactttactgtactctcttagggccttagacacgcttcggaatgtagcacctccgtcacagatatcgtcgatcactagaagcggaagctcaggatcaatatccgaaggattcagaatttcaaagccttcgattttgccggtctgaagatcgcgcttcttgttgcaacgaattacagtggctgcaccagttttctttgcaaaatcctcggtccgctttgttgctccgatatcaggggctacgagttggtactgctcccactctgagcggttcagcaggccgccgaagaccgaagattgacgaacaacttcgacgttgttaatcaggtgcagagttgcgtcgctgtgagggtccacaacgataactcggtcgtacccggcagagttcagcatgtttgcaaacactttcaaactgaaggcgtcgcccggattgcaccgacggtcttggcgggcatacgggacataacctagcagaagcgtcatgtgtggattaatcatttctgctcggatcgcttcagtgacattgaggagagccatgatatcatcgctgttcttaatctgagctttaacgtttacgaacgcatggctttcgatgcctgccacattgacgcccacttcgccgcccgggaacgtccacacttttgcctcttgccacggacggctcataacaccttccatttcgtgaagacaacctacagcataactaatcatacatcctcctcacagtttcacagagaagcgcttccgcattgcttccatggtgctctcagggacgtcgtgtacagacttattcccatgacgattctctacaatcagagagatcacagtgtagccaaactcttcagccatgtcaatgtacggttccacctctcgctcccgggtgctagtattggacacgatcacagcgtcaagaccggccttcatagagtttcgggctttctccatgcacttattatgggactctactacacgctctgccttccacacgtactctccatactccatctggtagtcatcagcctcgcagatggatgccgtcccaccagactcccaaatctggtggtataaaatccgggcaaatgaggacttcccggagcccgggagtcctcgaatgatatacatgatcttttcctgcatattccctcctttaaattctagtcatatcgaagtaggtttcgatcagaagacgccgctgggcatcagtcatttctacgaaacaggactcctctacttcatttaccaagaagtctaccagaggatagaactcttcgtcaagcgtctgcttgaatccagccgggtcttggtacatcgcattgaccttcttactacccatcctcatgataaacttcttgccgaggtagtgagttgacttgcacttcactgtccctagccctgtttgtaccatgtaaccttctttctcacaagaactcagaagaccctttgcatgttcccagctacactctatgtgctctggacgaagaatctttacagaactgtggtccgttacacctagggcgtgagagtcaagaatatattctgaaagctggcccccagtgaagatatcgcggataccgatcaaatatgccccttcttcttcctcgacaatgtgagggtcgtctggagagcatatctcgaagttatatgtgaagcctgcgatgtaatcatctgggttattcgacacatacttctgaccaagggcaacgtaatcgccggtcaatgaccccgtagtactgaagataagggagccattgtgcttagtcacggagaacatgaatccattcactttctcaatcagccgcacacggaatttaggatggaggaaactcccagcaccattctctcccagattaaacaccttctcgaaggggcgtacaatacaatcaccggagtgctggtcaaatacatgaccccgtgcctccagaaggagcggatgctcattccacaggttctcgtagaacaccttccgggcatactttataatcgacataccgttgaagtgcttaacagtcaccagcttattagcgatcaggtctttgtacattgcaatgttgagattaccttccatcctacttctccttatttcaattcgacaattgggcagaatttagccttctttgcctttagatacgataccagaatcccatccttgctggacgatttactcgacataaagcgagagaatcggtagaaaacccacacgccataaaagacggcgatgattccaatccatacaaaccccatgacagccagagtcccacctagaacatatccggtaagtggaccgagagccagagaatacaatacagagcctacaacagcagcgagcgctacaaccgttaacgccagccacacgacgaggaatactgtctgccagaaataagagcagagggttacaatttgccaaccgcttgagatagccgaatagaccggggtctcgaacgtacgatggagccgcatatgccacgaattcttatcaatcttcatgcttgttcctccgggaagatgttgaagttaagtacgttatgctcttcaagttccatggaggctaccatcttataacctccgagcttgtgaacgatctccagtatactctcaatagagaatttgtcaacatgctgcttcatcagattggagattcggctctgatgggttccacaccgctctgccacttcccgttgagtcagcccagactgagtgatgtagtgtgcagcaacaaccattacagttttcttgaaatccttgaccggatcattcatgttagtcctccttattgctcagcgttactttgccatcgaatactcggaattgagcgatctcaaactgatccgtccagcgggcgtcctcgaaagccactccttcaaaagtcccgtcttgtttaacatcagaagtcatgaggacgataaaaggaactccgtcgtcatggatcagttccaccagagtgttagctttaggtttaacatcctccttgtcacgcgaaatcaacacattgaccattctttcctccttttatttatggtggtctacaaccacaaactcttgctctcgcatatattccctcacttcgtcgtaagagaatacctgatgatctgggtgattgtcaatacctacatcaaggcgcttacccttggaaggcaggctaccgtgagtgtgaccatgcaggtgccaagcgccatgatgagcggtattccacgtctcgaaaggatagtggcacatgacgatcttaactccgtcgatcctcacttccttgtagtctcggatatcttcgacgtgcgataggttgctgtcttcaatcagcttccacagtcggctatcacagtgattacccttgaggaaggtgatccgaccgttcaactgtctaatgatatccagtacagcttgcagcttgttcttacctgcgaaagcgaaatcacctaagtgatacacttcatcccgaagacggacccgagagttccaccgagagataagctcctcggtctgctcctcgaaagtccacggcctgttgcaatactcgatcacattcttatggaagaagtgtagatcggaagagaaaaatacagacattatgcctccatttcaaattcgtaaattttgttaatcctgcggatgagtcgcatagcggcccctcccagcagatgttcacgctccggctccatactagccatagccttgaactctgataacatatctcgacgctcgtagtggaaatctactacccagtaatggtccgcactaatcttaccctctcggtacagatgcccttctacgcccagccagtgatctactgcgtctttcttcagaagctccttcggagaccacttatctacacctcgcagcttctcgaagaaagagtaaggacgcgaatagctgatgatagcttcctctacagccgattcagcctgcaattggactaactcccatcttgcaaggacttctttaatctccccggtggtgactggggtgtagctgtactgctctttatattcattccacactgtactgttctcctacatagcctttgaatttgtcggaacgagttgtcttcttccgtgccttgttttccagaactgatgcctccctttcgagcatgctcagttggttgctatacttcttgatccgcttcgagttaccactcatcacagaatttgtaagatttgcgatagtatcgcaaattttcacttctcttgcaaccggatgattacggcaagcttcgatatacttacggtagctctcagcacggttcttatcgagaatgaccaaagcctctacgatgtgaggcatcacgcccatggactccaagtcttcctctgtcaactctgtatcctccagaacgtcgtgcaggaagcacacagcgagaagagtgtccatgtacggaaggtcggagaaagcctgacccgggtccatatctttaggagcgttgcgagccacgcagactgtatgcacctgattcagatggtaagcatacgggaagttggtctctccgtaccgctgaccttcgtgagccgagagtgcgatctcaatagcgataccaagctgagtgttcatattagtctcctttgtagaatgtgtggttgcctatcttgattgtgcgcttgtatttcctagcccaccgaggaagcttgccattattagcccgtctcaccttcctctcgttgaggtagtgatcggctcctctcgttggatcgacagtatacccatatagggcgttgtatgcaacatgtttcgctgcctcccacttgtcaagctccttgacaccttgccgcatactcccatcgcaggtgtaggaatactggcacttgaagtagagcactccggctactgtgctcggccacctgtcgtgcttcattctgttcactacggtatgagctacagcaatctgaccgatctccggttctccccgggcctcgaagtatacagcttcagccaacaacctgcaaggctttctgtactcacacaaggtgcgcttgctttctatgatttgaccgggactggcttggaattccactacaggctccgtgccgtattttagacgagagtattccatgtcgaggaacatcccaatgaaggctagaaggatcgacaaaacgagagcttctaaggtttccataacacctccttagacaaagaagcccgccttgtgggcgggctgtatatcactcggctattatacttcagcccaagttgtaacgacgggcgtagtctttgttggggaactcgaccatcatcgactgaatgtgaatgttgcctttacgatccttctggattttggcatttttcacaatcttactagcctgcgcctttgccataagctctggacttacaaccagatcgatgaattctgcactccgatacccggcaccagccggggcccagaagccgtactgggtcaccgtcgatgtaggtacaaggtacaggttgtgcagacgcacagcagtgttgaaactcagcttgctgatgtgcttcgcttcccgagtttgggtttcaaaacacccagtcgtgtagttgaatttgtaagtgagagcatccatgaactgaatgacgcttcgaatctggatagcagaagtatccaagagctggaactcctcagccgcgtcgattgcagtggtcacgttgacagacttagcgttgaacattttatatcctccttattcttcagggacaaatacaccgccgattacccggccagcgcgaattagtttaccagttgggaactgagcacgcaaggtctttttgaaacgactttgaatttgcacagttagccacttaccccggtagttctcaaaattagtgatctgatccttgcgttcgtcaaagtcaccgtacgtcacctcaagcagctcttgaggtacagggtcaaacaccaccagaacagcgttcccattcttgtctaccacgtagttcacgatctgcatttccatatcgaagaactctttgtacttctggagaccactagaacgtttacctgattcgtacagtccttcaggactccgccacatgataccttcatagcctttctgtcgatacacatcatgaagacgtttcagttcttcaaaggtggagcagaatacgtactcgacgaagcgaattttaccgatcccggcaacagtcgcagccttgaactggaagtctaccagacgctccttgaatgtcaagccttctttcacgatatcgaatacgtgaaattccatccgcttacgaagaccgtaaataaaggacgtgctgtccacttcattcaggagacgatcatactcctcctctccgttctctagagcgtaggcgtcaagagccttctcagccttcatccacttatcgtaggcatcctctcgcttgaccgccgagttgatatcctccagcacctcaccgtggacgtacagttcgccgtcccacacatcaccctcttgcatgatctcttcgagttctttgatgatgtgcggtacattgtaaggtttacccatgcgagacgctagcgtaactacgccattggctttcttagccatgcaacgcaggccgtctagtttaggagagccatacccctctttgtatttagcgggatcaagcggttttgcgagcatagccataacagggagatcgttgagttcttccttggctgcacgataacccttgtccaactgcttgctcaccttggactgagcctcagacatggcctgctcctctacagagcgtttctgcttaccaactcggatgttggtaacctgagaggtcatggctccatgttctttgccgtatttcacgacgatattgaagctaccgtcttcctctccaaccacctctacagtccactccttgaacccgcctttcttgtcgagcccatatagtcgttgaaaataactcattgatcctcctcgtatttgatgacaagaacatcattctcccgtaggtgcctaagaccctcgtcgagccgatattcgtgcttatagtacactactttgatcccagcttcaaccaccgagatagcacaatttttacagcaagagtgagtgacgaacagggtagccccttgggcactctcagggctgcgtataagagccctcagtgcgttttcttcggcatgcctcacctctgccttggttactcccgtttcgtcctccagcggcccgtttaggtgctctggaagggcattatacccgcaactgatgatacggttacgttttactagaactgcaccaaccttggaacgagtcgagtcgctgcacttagcgaaggcctcagcggcctccatgtaagctttaatatgcttgaccttcacgactagcctccaattagaaccgcgatctcctcgtagtacccctcttcagggcacgcgaattccatgtagtactcgtcagtgtctgtcaaatagacaacgctaggcgggtaatagctccaagtcgggtctccgtgttcaatctccgctaccttcaagttgccatacacagtgcgaagagtctgtagagcctcgatcacatcgtcgatgcgcattacagtgggttcagtcggttcagtcatatctcctccttagttttctactttacaaacggcatcgccccggcgaaggaacacttgcactgatggctttccgctccacttgtcccacgcttcagctttaacactgacagtcttaggattgattgcaaccacctcgcctaccagcataaccattccagttccgcctaggcagaatgctactgcgtcgccgatctcgatatcccttcctgctacgtccttcatttgtactctccatctgcacccttgattaaaataacgaagtccgagggatcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgaccgttacgttttactactttcatatttcctcctatcgcttctgtccgcttacgtcaaagtacgatttccattcttctccgaatagttctctacccttatcatcgtagactttatgagcctcttctgctgttttatagcaaccgaggtaaattctcttaccttcatacctgatccgggcaacgtacctgttgtttctaaaaaagataccgggatacccgtttgtattacgggtagacgcgggtttattctgctgctgctccgagtccgtcgcccaccggcaattagacttgcaatacccttttgtcgagtcctttctatcgagagtctttttctcgggtcgttctcccatgtcctcatagaacccctcgaatgtcttccacttaggatcgatggtaacatccttataatatttgtaactcttgtgctttgggttcgtacatctgtcgatcattgtcctccaagaattgtatgtcggagttccgtacattccatgggaggatagtagtttagactgcatgcacccgcaactcttattatctcctaccttgagtgctccagttctaattttcaaaattgccccgcagatgcattcgcatagccaaagaacctctcttgaattactcctcgctccagagtctccgactaccctgagatatgtgaatgtctgccctgtcaggtctttaactgccatcctacctccttacttgacgagtggctacgccgtaagctggcttgctcccctcgcccgtgttgtgtttcttctgcactcggctggcattgacggtgtaacgccctttgccatactcttcatctatccacgcttgggccttagctcgctgagacgtgtggacaaagatgtagtagccagatgcatccttgataaaccaagtggccgggggctggaagtccagacgtgaaaactcttcatagtcgatcacagtcaccttctgcttagccactgtatactgccccactaccgactcttttgcaatgattttatcaatcatctgagttgaaagatcagagttcttcgaggtcaatttctacctcctttcctagtccagtatctgcaaagaagctatcgagactcagagcgtggtattgagacactttgtaaccaccactcttcagaaggctgtgagcggcctcctctactttgtcctctgtcagtctccagtccgcacctaggagtacttcagctaactgctctacactcggagggttcccaatccacagacccattctactgtcaggctcgtaatcttcttcccatacaagttcccacactaggttactcattggtacacctccttcttacgaatagaatacataacccactcgtcttttcctgtcttcccgcacggaatgtctacttcacactctgcgtttacaatcaggcccgctacgatgaaatcaagaagctcctcgtctggttctggcaagcccgggtaggacgatacaaccctgcggatagtctccgctttggtattgcccagtaccccaagcatgtggagatcgaactctccactgtagtcgtcccagagttgtccaaatatcacccatacactattcatacctagtaatcctccttcagcttgttggtgtccattaggcagcctccttcttcttgtccagcaacttaaggcatcgtttgcaggtgatatgattgcggtagcgggagaagttcttctcctcgaagtcgccatcggtgccacagaagacgtcatacggttcttcactgtccgcttctgtgccgcagtcccactcgtcgtagtgaactgttcgcgtcgccattcacttcacctcgattccggcttgctggagggcttctttcacggcatcaagcactgcgttgtagctgccgattatcaggttgccgtagatgtttcttgtgggctccattttctccggcaactccaccctcagagccgcgcggctggcttgccatatccgccagtcatgatgtggtgtgtcgtggatgtattgatgcggcggatgctcatatcgatcaagggtgaagccatggtgcccatccttaatttgggccgcgtagttacgcacgaaccacgcttcaaactcgtctctcatactccgcaatcctcctgaatctcttttagcagctcggaaggcataaccgacagcgccagttcctccagagcatggatgtaatcctcaacatatttccactcctttctgatcttctgaaggtacacgccttctttactgttgtcaatagcctgaccctccaactcctgcataagttcgaacatcttgtatatcctcctttggccgaaaaaatggccggcgactactgtcccggcctgatgatactactctgaaatttcttccattgcaaggcgtttcttttcaaagaagtcactgagcttatcttctagctcttcgccaccaatgtaaagctcttcccctgccttgacacgctctagctccttctcagtcaagaagtcactgtagacgtgatctacccatttatcgcaccacgctgagctaaacgctgcattcctcagactattcctgaaatcagcagatacaacgccaaaagaaggcgcgtggatcatgaaatatgtgaactggtcgatctcaacggagtcgcaggctagcgcgatggcagtcatggcagacgcacactcaccttcgagacgagcatgcactggagcttgacactccttgatcgctcggattatagcgttggcggtctctacctgtccaccgcatccgttaatggtgatgtacacttcatcattctgacctgcattttcaagggtccaaagctcctctgtgagttcttcgaggctcttgattacgtatggcagaaggatggagtaacgattgctaacactttgtgtacatgaaacaggcataatacctcctttacaaaaatgggcccgaaagggcccttattactgaatcactcctcgctttctttctggccagagcccagcattgcaaagaatggaaggaggattgtgctcagctctccgctgacagcttcaccaacttctgcaccagcctgagctacactcaggaactcttcagtgcgtacaaacttgtcaaccttgacgagggttttaaagtctactcgttccaagaacgcagtcccggctgcttccgccagaggttcgaggtttacgacttccatagcgcgatccagagcttcctgattgatctctaggccgttctgggctgcaacctgcatcagggtagacttcacagtctggattgcgtagtctttgaaaaactcacgttgtgctttgttaaacttcattcacttttctcctttgtagtacgacgacgacgggtttttggtttatcttccgattcagtctcttggacttcctctacaggaacttccttagctacttctgtagacttttcctcagtctgcttctctgcgccttctcggaccatctttacagacttgagagcgaaattcatattggcgaaatgagggtcttcgagatcaatgcggaaaccttgatcgaaagcattttgcatgcccatcagaaggctgaaaacgtcccattcttgcacaatgacctcattgccgtcaagctctttttcaatctcagggctgacgccttcctgccggaacatctgcacttgacagagggtaccgtacacaggatagccttcaatcgaccgaacgacacggaaaccttccttcatgtgggcgtgaatcgagcgaagccagacgatagggttgtattctacgatattgataacttgcatattctttttactccttgcgggttagtgttttacaataataccacgtttctcaggaatgtcaacccattttgttctggtaaaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacataccacagataatccatcaatcaacccataaggaatttctatgagatgtaagtgctgtgatagcgaactctcgtttgagactccagtcatcaataaacatactggtaaggaagacgatctatgctcctcttgccgtaggtttgctctcaatcctacactggatcatgagtattttggtggttggtatccaagcgaaggggttaccgctcctctgccgaccggggactgacattgtatatagagtgcgcgtactctgacaatacatataaataatagattacggtgcgaataattctttaagggcttgacaacaggagatttcgtgctataatcggagtatatggggcttacaaagcctcagaggatttaatatgactcaagaaagaaacaagggcggtcgccctacgaatgccgagctagaagcccggggtatcattcaaacagacctaaaagcaggactcagacttctaaagaagagctttgcagagaacattaggttcctacaagagcaatctgacaatcctgaggtttctctacaaatgagaatcaagctcaagaaagagctttctgatatgttcgtcgcttactacaaagctgacattgcactcaaaaaagagcttgcaaaaggaacagaatcaggagataatgagaacactgaagaggacaagactcccggagtagttctcgcgttttgattaattgccgcttcgttcaatggtaggacgccagactttgaatctggagatgatggttcgatcccatcagcggctgccaaatgtagtaaaagaacattcacccgacaaggaatgtgtctcgctcagaggacagcgagtaataagtgtcctccagaattaagggtcggtgagcgtaattggcaacctactggattccaaatcctcgtattctctgttcgaatcggagtcggcccgccaaattagtgttgacaggagagaaggtctcctgtatagtgacgccaattgctcgtatagtgtaacggatgcacaacggtcttctaagccgtaaggtctaggttcgaatcctagtatgagcgccaaattatagggttggccgatcagcgctaggaggtagcttgaaacaatgtacacaatgcaaggttgaaaagcctacaaccgagttctacttcaagggtagaaaagctgacggtagactccattccgaatgtaagaaatgctttaacaatcggatgatgaagcgatacgaacaaagggccaaagtgattgttgacatgaaaggtggaagctgctacctttgtggatatgacaaatgcgttgctgctcttgagttccaccacatggaccctagtcagaaggactttgagatttcgaagcggtggagcatgaaagacgaaagaatcaaagcagagattgataaatgcgtcctgctttgttctaattgccacgcggaggttcactacaatgaagcccgtggcaagatttacaattggacggaagctaaagtggtcccggcatctggcttttaaccagaccttagtgagttcgagtctcacccgttcaaccaaatttagtgagtaaatcagatgggttctgaggctccctgctaaggagtacgtctgctaacgcggatgtggatcgagaccactgctcactgccaaaataagtgattttaagtgttgacaaactgaatttttcatgttttaatacacttatcagatcaagaaatacttagcgagtagctctgagtaggtcgggaactagtctagaaaactaggccactgtgatgaacggtgagggttcaactcctttactcgctgccaaattaaggccctgtggtggaattggtatacacatcagtcttagaaactgacgccgagaggattgagggttcaagtccctccggggccaccaaattaagaatctcttttgctatttggtaagggttcgagtcccttcccggctgctatggtcggtctacggtggccaaatagtgagagagctaggggacatgacgaaggtagcgctgctttccgatctccccggcgctataaaagttatcatgaaggggttgacaaacaagaaattcatgataatataggtacatagagtaacaaacaatatggccagatagctcaattggtagagcacccgaccgataatcgggtggttgaaggttcaagtccttctctggccaccaaaatttataggcccattagctcagtctggactagagcaagcccctgtctagggcaaggtcgccggttcgaatccggcatgggtcgccaacaaggtcgttgtagagatagatggctactatcatccggctgtaacccggacgccataggctagaggttcaattccttccttcgaccaccaaatagcgagagcgttaagactggctggcgctgtcactcggctcataaccgaatacaagtggttcgattccacctctcgcttccaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggag

SEQ ID NO: 2 - DNA, 89501 bp, Pseudomonas bacteriophage F110/10
ttattggatatataatccagccagcctgcctcgaacgctgaatccgctcccttcgctcctcctgaccgaagaataaaaccttgttctgccagtttacggcctacctctcgaaggatgccccattctctgttcggagtgtccctgcttccgactcctgtataatatctcatcgtctcaccatttgtcccagttctccgtatgtaatccagtggtgacgataatccccttcttggttggtgtactccactaacaccggatagaagttgtctgcgtggtctatgtttaccaccttgcattcacatcctctgggaatagtgtatccatcgctgctcatggttaagagcattccccggtacacgtcttttatctctagctcaccttctccagactcttcaaacttgagtctcaatttctcgattatttgagcttgcaaatagagaagttcgtacgctgttaagttgtccagatcaatagacatgtcactctctcccttctagtttcttgaatgccttgtccagtttggctagatgcttatccaacttgtctagctttttatcctgataaagctggaacgcctccgagcccggggccaaccaagtccccttatacttaattgcaccccggatcatatctcctcctattacagttcgtaaacgtatacctgaaactggccgagcgtctcctcgataagaggctcgacattgctccagtcctctccggctaaaccgcagccaatcttcggcagacctacacacaactccgaggtaggaatcgcccgagcgtcagcctctgcctcaaggaacagagacatagtgtacagggcttggcccagtgcgccaagctgagtgtagactcgtccctcttctcggccatagttgtactgcccgtacagattgtaaatcgatccatactcgttaattgtgaaggtgagggagccgagtttgcctcgatcccctttcaccgttgcttggtctgcctcgtaggcctccgggaattgctcccggatttgcttagcaatgccgctgcccatggtgttgaagcaattagcctgatgtgcaatagcgtgcaactctttgtttttgaacgctgcgataagatcgccctttcggtatttaatcatttgaacctctctacacttgtgaacctgacttcagcgcctctcgctccgtgagcaatgtccgagtacatcgagttcatggccgcaaacggagaccaatactccttctcccagattctgaacttgaacaatttgtgccctttgttttctgggcgtccttgctcgcagaaggttgtaaaatagtatttagccaccacctctcctccttatacgccgttcttaatccggtagcggatcgactctagatcattattcttcaggtcttcggtgttccattttccgtctttgaagaacgtcctcaagtgcccagtctcttcctcttccttcgttacattgtctttcagtcggaggaaccgtccgttctcttggtctcggtacactttcaagagacctttagccgacttcttcttgctgtcagttttcgggtctttgaagatcgcgataccttcaccattcacttccgtgtaggtagctttcactgcgaatccgaaagtatcccgggtgttgcactggtaagtgtaactgccaactccaaacactacgttcagggaagcgaaacctttctccttcaagcgctccaagattttagctgctcggcgagtcgtaatggaatccccatagatcaaaccgatatgagaatcgagcatcttataacctgcttcattcacagtaccgccgaaggtttcccacagaacttggatagctcccttcacctgtgcctcgctcacttcttcgagtttatagccaactacatactcgtattgatcccactcagtgggaataaccttgaagtacttatcttcaaagttcagaacaaaggcgtcgtttccattaactgcatccatgatatcccagtgttcgagagattcaacaacttcaatatcgcctagtccgcagataacctctacaggatcaccagagtctggacgaataaccagcttgccatctcgctccatgatctgatccttgatggatggcagaatgtcagtaagcacgccccagaagtcaaagctatctgccacgtacgacagaataccactagggaacttacccatcagttcgataaggaatcgacgttctgcttcctcacggccaccttcaccttccccatcctgcatttctttctcaatacggaggatgttgctagtagctacagcgtgttcagtcgcaggtacggagcaagctaccagaccagttgcgctatagtaatcctcagcataaatagctgctgccaaggtgtccgagcctacgaacgaggtcaagtgaccaacaccacttcgggccgcgtcttcgatcccactcatgccccgggcactgaaatcgtggaactgaacggacaacaggaaatcgtcatagcatccagtatgattcgcgtagtatcggcccatagctgcgtattctgcggcaatggtagcgttggttgcagtcttccaagtcatagccgaaatcagcgtctcatggtagttaaccaaccaatagaactccggcagggtgttcttgatagtaagcaccggtacgcccataggaacgctaacgccctcggtcaaagacttgacctccagaggcagatagccgagcttgtgtagggctcgaagctgctccacagcctccatttcccggccaaaatagccagtcaggaaccgggaataccggccaacggcgttctcttcttcagccgcgaagaagccttcccaagactctacgatctccatccaagcggcccgtccgccgacccacttgagagtgccgtcgtagaagtcggtggcatgcgtctttcgataaatcttatcggagcgaggggtcaggttgctatagacaagctgagttccttccgagtacatggagccgtgtccaatcttgtacccatcagtggaaagatgcggcagaattttcatgttatttcctcctgttgtgttgaataggcccagactacatcaatctgggcctcctgtcaatattcgacttcttctactggcagcgtcagcacagggtagatgcatggaaggcgcagcaatggttgcttcttgctgtggaagtcttcccaaaacttatcgtgcatcgtcttgtaccgagcgtccagttcctccttggtgtcgaactcctccaccttgacaaccctcttctctggagccgaacgcttatactctacaatccagatactcaagctcacaggcgttccgccttagagtattcaaccggaatgacagttagcgcttcgtgctctttttgagggagcgtgtccgatgtgtagatgcatccgaaggaatccagcaagcagtcgatacccttactgaagattccatgagtgacgaacaggtcagggagcactttactgtactctctcagggccttagatacgcttcggaatgtagctcctccgtcgcagatatcgtcgatcaccagaagcggaagttcaggatcgatatccgaaggattcagaatttcaaagccttcgattttaccggtctggagatcgcgcttcttattgcaacgaattacagcggctgctccggccttctttgcaaaatcctcggtccgctttgttgctccgatatcaggggctacgagttggtactgctcccactctgagcggttcagcaggccaccgaagaccgaagattgacgaacaacttcgacgttgttaatcaggtgcagagttgcgtcgctgtgagggtccacaacgataactcggtcgtatccggcagagttcagcaggtttgcaaacactttcaaactgaaggcgtcgcccggattgcaccgacggtcttggcgagcatacgggacataacccagcagaagagtcatgtgcggattaatcatttctgctctgatcgcctcggtgacgttgagaagagccatgatatcatcactattctgaatctgagctttaacgtttacgaacgcatggctttcgatgccgcccacattaacgcccacttcgccgcccgggaacgtccacacttttgcctcttgccacggacggctcataacaccttccatttcatgaagacaacctacagaataactaatcatatatcctcctcacagtttcacagagaagcgatttcgcattgcttccatggtgctctcagggacgtcgtgtacagacttattcccatggcgattctctacaatcagagaaataacagtgtagccaaactcttcggccatgtcaatataaggcttgatctctcgttcccgggtactagtgtttgatacaataaccgcatctagtcctatctccatagaccttcgagccttgtccatgcactttttatgggattcagctacccgctcagctttccacacatacttgccgaactccatttggtaatcgtccgcttcgcagatagacgcctgccggcctgactcccaagccttgttatacagaatctcggcaagagaggacttcccggaacccgggagtcctcgaatgatgtacagaatcttctccttcacatatcctcctttagattcgagccatgtcgaaataggtctcgatcagaagacggcgctgtgcgtcagtcatttctgagaaccgagcctcatccacttcatttaccaagaagtctaccagaggatagaactcttcgtcaagcgtctgcttgaatccagccgggtcttggtacatcgcattgaccttcttactacccatcctcatgatgaacttcttaccaaggtagtgagtcgacttgcacttcaccgtccctagtcctgtcttcaccatgtaaccttctttctcgcaagaactcagaagacccttcgcatgttcccagctacactctatgtgctctggacgaagaatctttacagaacggtgatccgttacacctagagcgtgagcatcaaggatatgctccgcaagctgatcgccagtgaagatatcgcggataccgatcaaatatgccccttcttcttcctcgacaatgtgagggtcgtctggagagcatatctcgaagttgtatgtaaatccagcaatataatcatctgggttattcgacacatacttctgaccaagggcaacgtaatcgctggtcaatgaccctgtagtactgaagataagggagccattgtgcttagtcacggagaacatgaatccattcactttctcgatcagccgtacacggaatttaggatggaggaaactcccagcaccattctctcccagattaaacaccttctcgaagggacgtacaatacaatcgccggagtactggtcaaatacatgaccccgtgcctccagaaggagcggatgctcattccacaggttttcgtagaacaccttccgggcatacttgataatcgacatgccgttgaagtgcttaacagtcaccagcttattagcgattaagtctttatacattgcaatgttgagattaccttccatcctacttctccttatttcaattcgacaatcgggcagaatttagccttctttgcctttagatacgataccagaatcccatccttgctggacgatttactcgacataaagcgagagaatcggtagaaaacccacacgccataaaagacggcgatgatcccaatccatacaaaccccatgacagccagagtcccacctagaacatatccggtaagtggaccgagagccagagaatacaatacagagcctacaacagcagcgagcgctacaaccgttgacgccagccacacgacgaggaatactgtctgccagaaataagagcagagggttacactgtgccaatcgcttgagatagccgaatagaccggggtctcgaacgtacgatggagccacatatgccacgaattcttatcaatcttcatgcttgttcctccgggaagatgttgaagttaagtacgttatgctcttcaagttccatggaggctaccatcttgtagcctccgagcttgttaacgatctccagtatactctcaatagagaatttgtcaacatgctgcttcatcagattggagattcgactctgatgtgttccgcaccgttctgccacttcccgctgagttagcccagactgagagatgtagtgtgcagcaacaaccattgcagcctttttgaaatccttgaccggatcgttcatgttagtcctccttattgctcagcgtcactttaccattgaatactcggaattgggcgatctcaaactgatctgtccattgagcgtcctcgaaagacactccttcgaatgtgccatcttgttttacatccgaggtcatgaggacgacgaaaggaactccgtcgtcgtggatcagttcaaccagagtgttagctttaggtgcaacaccgtgctcgctacgcgaaatcaacacattgaccattctttcctcctttacttgtgatgatctacgaccacaaactcttgctctcgcatgtattccctcacttcgtcgtaagagaatacctgatgatccgggtgattgtcaatacctacatcaagtcgcttacccttggaaggcagactaccgtgagtgtggccgtgcaggtgccaagcgccgtggtgggcagtattccacgtctcgaaaggatagtgacacatgacgatcttaactccatcgatcctcacttccttatagtctcggatatcttcgacgtgcgatagattactgtcttcaatcagtttccacagtcggctatcgcagtggttacccttgaggaaggtgatccgaccgttcaactgtctaatgatatccagtacagcttgcagcttgttcttacctgcgaaagcgaaatcacctaagtgatacacttcatcccgaagacggacccgagagttccaccgagagataagctcctcggtctgctcctcgaaagtccacggcctgttgcaatactcgatcacattcttatggaagaagtgtagatcggaagagaaaaatacagacattatgcctccatttcaaattcgtaaattttgttaatcctgcggatgagtcgcatagcggcccctcccagcagatgttcacgctccggctccatactagccatagccttgaactctgataacatatctcgacgctcgtagtggaaatctactacccagtaatggtccgcactaatcttaccctctcggtacagatgcccttctacgcccagccagtgatctactgcgtctttcttcagaagctccttcggagaccacttatctacacctcgcagcttctcgaagaaagagtaaggacgagaatagctgatgatagcttcctctacagccgattcagcctgcaattggactaactcccatcttgcaaggacttctttaatctccccggtggtgactggggtgtagctgtactgctctttatattcattccacactgtactgttctcctacatagcctttgaatttgtcggaacgagttgtcttcttccgtgccttgttttccagaactgatgcttccctttcgagcatgctcagttggttgctatacttcttgatccgcttcgagttaccactcatcacagaatttgtaagatttgcgatagtatcgcagattttcacttctcttgcaaccggatgattacggcaagcttcgatatacttacggtagctctcagcacggttcttatcgagaatgaccagagcctctacgatgtgaggcatcacgcccatggactccaagtcttcctctgtcaactctgtatcctccagaacgtcgtgcaggaagcacacagcgagaagagtgtccatgtacggaaggtcggagaaagcctgacccgggtccatatctttaggagcgttgcgagccacgcagactgtatgcacctgattcagatggtaagcatacgggaagttggtctctccgtaccgctgaccttcgtgagccgagagtgcgatctcaatagcgataccaagctgagtgttcatattagtctcctttgtagaatgtgtggttgcctatcttgattgtgcgcttgtatttcctagcccaccgaggaagcttgccattattagcccgtctcaccttcctctcgttgaggtagtgatcggctcctctcgttggatcgacagtatacccatatagggcgttgtatgcaacatgtttcgctgcctcccacttgtcaagctccttgacaccttgccgcatactcccatcgcaggtgtaggaatactggcacttgaagtagagcactccggctactgtgctcggccacctgtcgtgcttcattctgttcactacggtgtgtgctacagcaatctgaccgatctccggttctccccgggcctcgaagtatacagcttcagccaacaacctgcaaggctttctgtactcacacaaggtgcgcttgctttctatgatttgaccgggactggcttggaactctactacaggttctgtgccgtatttgagacgagagtattccatatctaggaacatcccaataaaagctagaaggatcgacaaaacgagagcttctaaggtttccataatacctccttagacaaagaagcccgccttgtgggcgggctttatggcgggtttatcagtcttgcagcacggaataacgtcgagcaaaatcctcgttagcgaatttaacgagtacagactggacatggatgttgcctttccggtccttctgaatcttggcttcttttacgatcttgttcgcttgagcaacagccataagctcagggcttacaaccagatcgatgaaccctgcggtacggaatccagctcctgctgcctgccagcagtagtggccgataggcttgatgctgggtacataacccatgttgtgcaggcgtacagcagtgttgaagctcagcttgctaatatgctttactgcccggacttcagtttcgaagtagccagtagtgtagttgaaatgatagctgagcgcttccatgaactgaatcacactccggatttggacaacagaggtgtccagcaattgcagtttctcggcttgctccaaggcagaagcgatgtgtacagatttagtgttaaacatttttaatcctccttattcttcagggacaaatacaccgccgattacccggccagcgcgaattagtttaccagttgggaactgagcacgcaaggtctttttgaaacgactttgaatttgcacagtcagccatttacctcggtagttctcgaagtttgcaatctgatccttacgagcatcaaagtcaccatatgtcacctcaagacgctcttctggcacaggatcgaatactaccaataccgcatttccgttcttgtcttcaacgtagccgatgatttgcatttccatgtcgaagaactctttgtacttctgaagaccactagagcgtttacctgattcgtacagtccttcagggctacgccacatgataccttcataccctttctgccggtacacgtcatgaagacgtttcagttcttcgaaagtggagcagaatacgtactcaacaaaacgaatactccccagaccactgtgtagtgcagactggaactggaagtctaccagacgctccttaaatgtcaaggcatcttttacgatatcgaagacatggaactccatccgcttacgaagaccgtaaataaaggacgtgctgtccacttccttcaggagacgatcatactcctcctctccgttctctagagcgtaggcgtcaagagccttctcagccttcatccacttatcgtaggcatcctctcgcttgaccgccgagttgatatcctccagcacctcaccgtggacgtacagttcgccgtcccacacatcaccctcttgcatgatctcttcgagttctttgatgatgtgcggtacattgtaaggtttacccatgcgagacgctagcgtaactacgccattggctttcttagccatgcaacgcaggccgtctagtttaggagagccatacccctctttgtatttagcgggatcaagcggttttgcgagcatagccataacagggagatcgttgagttcttccttggttgcacgataacccttgtccaactgcttgctcaccttggactgagcctcagacacggcctgctcctctacagagcgtttctgcttaccaactcggatgttggtaacctgagaggtcatggctccatgctctttgccgtatttcacgacaatattgaagctaccgtcttcctctccgaccacctctacagtccactccttgaacccgcctttcttgtcgagtccgtacagtcgttgaaaataactcattggtcctcctcgtatttgatgacaagaacatcattctcccgtaggtgcctaagaccttcgtcgagccgatattcgtgcttatagtacactactttgatcccagcttcaaccaccgagatagcacaatttttacagcaagagtgagtgacgaacagggtagccccttgggcactctcagggctgcgtataagggccctcagtgcgttttcttcagcatgcctcacctctgctttggttactcccgtttcgtcctccagcggcccgtttaggtgctctggaagggcattatacccgcaactgatgatacggttacgttttactagaactgcaccaaccttggaacgagtcgagtcgctgcacttagcgaaggcctcagcggcctccatgtaagctttaatatgcttgaccttcacgactagcctccaattagaactgcaatctcctcgtagtacccctcttcagggcacgcgaattccatgtagtactcgtcagtgtctgtcaaatagacaacgctaggcgggtaatagctccaagtcgggtctccgtgttcaatctccgctaccttcaagttgccatacacagtgcgaagagtctgtagagcctcgatcacatcatcgatacgcattacagtgggttcagtcatatctcctccttagttttctactttacaaacggcatcgccacgtcgaaggaacacttgcactgatggctttccgctccacttgtcccacgcttcagctttaacactgacagtcttaggattgattgcaaccacctcgcctaccagcataaccattccagttccgcctaggcagaatgctactgcgtcgccgatctcgatatcccttcctgctacgtccttcatttgtactctccatctgcacccttgattaaaataacgaagtccgaggggtcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgaccgttacgttttactactttcatatttcctcctatcgcttctgtccgcttacgtcaaagtacgatttccattcttctccgaatagttctctacccttatcatcgtagactttatgagcctcttctgctgttttatagcaaccgaggtaaattctcttaccttcatacctgatccgggcaacgtacctgttgtttctaaaaaagataccgggatacccgtttgtattacgggtagacgcgggtttattctgctgctgctccgagtccgtcgcccaccggcaattagacttgcaatacccttttgtcgagtcctttctatcgagagtctttttctcgggtcgttctcccatgtcctcatagaacccctcgaatgtcttccacttaggatcgatggtaacatccttataatatttgtaactcttgtgctttgggttcgtacatctgtcgatcattgtcctccaagaattgtatgtcggagttccgtacattccatgggaggatagtagtttagactgcatgcacccgcaactcttattatctcctaccttgagtgctccagttctaattttcaaaattgccccgcagatgcattcgcatagccaaagaacctctcttgaattactcctcgctccagagtctccgactaccctgagatatgtgaatgtctgccctgtcaggtctttaactgccatcctacctccttacttgacgagtggctacgccgtaagccggcttgctcccctcgcctgtgttatgcttcttctgcactcgactggcattgacggtgtaacgccctttgccatattcttcatcgatccacgcttgagccttagctcgctgagacgtgtggacaaagatgtagtagccagatgcatccttgatgaaccaagtggccgggggctggaagtccagacgtgaaaactcttcatagtcgatcacagtcaccttctgcttagccactgtatactgccccactaccgactcttttgcaatgattttatcaatcatctgagttgaaagatcagagttcttcgaggtcaatttctacctcctttcctagtccagtatctgcaaagaagctatcgagacacagagagtggtattgagacactttgtaaccaccgcacttcagtaggctgtgagcagcctcttccaccttatcatctgtcagtctccagcacgcccctaggagtacttcagctaactgatctacacttggagggttctcaatccacagccccattctattgtcaggctcgtattcttcttcccatacaagttcccacactaggttactcactgatatacctccttcttacgaatagaatacataacccactcgtcttttcctgtcttcccgcacggaatgtctatttcgcactctgcgtttacaatcaggtctgctacaatgcagtcaagaagctcctcgtctggctctggtaagcccgggtaggacgatataaccctgcggatagtctccgctttggtattgcccagtaccccgagcatgtggaggtcgaactctccactgtagtcgtcccagagttgtccaaatatcacccatacactattcatacctagtaatcctccttcagcttgttggtgtccattaggcagcctccttcttcttgtccagcaacttcaggcatcgtttgcaggtgatatgattgcggtagcgggagaagttcttctcctcgaagtcgccatcggtgccacagaagacgtcatatggttcttcactatccgcttctgtgccgccgtcccactcgtcgtagtgaactgttcgcgtcgccattcacttcacctcgattccggctcgctggagggcttctttcacggcatcaagcactgcgttgtagctgccgattatcaggttgccgtagatgtttcttgtgggctccattttctccggcaactccaccctcagagccgcgcggctggcttgccatatccgccagtcatgatgtggtgtgtcgtggatgtattgatgcggcggatgctcatatcgatcaagggtgaagccatggtgcccatccttaatttgggccgcgtagttacgcacgaaccacgcttcaaactcgtctctcatactccgcaatcctcctgaatctcttttagcagctcggaaggcataaccgacagcgccagttcctccagagcatggatgtaatcctcaacatatttccactcctttctgatcttctgaaggtacacgccttctttactgttgtcaatagcccaacccttcagttcctgcattagttcgaacatcttgtatatcctcctttggccgcaaaaatggccggcgactaatgtcccggcctgatgatactactctgaaatttcttccattgcaaggcgtttcttttcaaagaaatcgctgagcttgtcttctagctcttcgccaccgatgtaaagctcttctcctgccttgacacgctctagctccttctcagtcaagaagtcactgtagacgtgatctacccatttatcgcaccacgctgagctaaacgctgcattcctcaggctattcctgaaatcagcagatacaacgccaaaagaaggcgcgtggatcatgaaatatgtgaactggtcgatctcaacggagtcgcaggctagcgctatggcagtcatggcagacgcacactcgccttcaagacgtgcatgcactggagcttgacactctttgatcgctcggattatagcgttggcggtctctacctgtccaccgcatccgttaatggtgatgtacacttcatcattctgacctgcattttcaagggtccaaagctcctctgtgagttcttcgaggctcttgattacgtacggcagaaggatggagtaacgattgctaacactttgtgtacatgaaacaggcataatacctcctttacaaaaatgggcccgaaagggcccttattactgaatcactcctcgctttctttctggccagagtccagcattgcaaagaatggaaggaggattgtgctcagctctccgctgacagcttcaccaacttctgcaccagcctgagctacactcaggaattcttcagtgcgtacaaacttgtcaaccttgacgagggttttaaagtctactcgttccaagaacgcagtcccggctgcttccgccagaggttcgaggtttacgacttccatagcgcgatccagagcttcctgattgatctctaggccgttctgggctgcaacctgcatcagggtagacttcacagtctggattgcgtagtctttgaaaaactcacgttgtgctttgttaaacttcattcacttttctcctttgtagtacgacgacggcgggtttttggtttttcttcagcttcagtctcttgggcttcctctacaggagcttccttgacttcttctgtgaccttttcttcagtctgcttctctgcaccctcgcggatcatcttgacagacttgagagcgaaattcatattggcgaaatgagggtcttcgagatcaatgcggaaaccttgatcgaaagcattttgcatgcccatcagaaggctgaaaacgtcccattcttgcacaatgacctcattgccgtcaagctctttttcaatctcagggctgacgccttcctgccggaacatctgcacttgacagagggtaccgtacacaggatagccttcaatcgaccgaacgacacggaaaccttccttcatgtgggcgtgaatcgagcgaagccagacgatagggttgtattctacgatattgataacttgcatattctttttactccttgcgggttagtgttttacaataataccacgtttctcaggaatgtcaacccattttgttctggtaaaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacatacacaaatacccaccacagataacccatcaatcaacccataaggaatttctatgagatgtaagtgctgtgatagcgaactctcgtttgagactccagtcatcaataaacatactggtaaggaggacgatctctgctcctcttgccgtaggtttgctctcaatcctacactggatcatgagtattttggtggttggtatccaagcgaaggggttaccgctcctctgccgaccggggactgacattgtatatagagtgcgcgtactctgacaatacatataaataatagattacggtgcgaataattctttaagggcttgacaacaggagatttcgtgctataatcggagtatatggggcttacaaagcttcagaggatttaatatgactcaagaaagaaacaagggcggtcgccctacgaatgccgagctagaagcccggggtatcattcaaacagacctaaaagcaggactcagacttctaaagaagagctttgcagagaacattaggttcctacaagagcaatctgacaatcctgaggtttctctacaaatgagaatcaagctcaagaaagagctttctgatatgttcgtcgcttactacaaagctgacattgcactcaaaaaagagcttgcaaaaggaacagaatcaggagataatgagaacactgaagaggacaagactcccggagtagttctcgcgttttgattaattgccgcttcgttcaatggtaggacgccagactttgaatctggagatgatggttcgatcccatcagcggctgccaaatgtagtaaaagaacattcacccgacaaggaatgtgtctcgctcagaggacagcgagtaataagtgtcctccagaattaagggtcggtgagcgtaattggcaacctactggattccaaatcctcgtattctctgttcgaatcggagtcggcccgccaaattagtgttgacaggagcaaagcactcctgtatagttacaccaactgctcgtatagtgtaatggacagcacaacggtcttctaagccgtaaggtctaggttcgaatcctagtatgagcgccaaattagatagggataaccggccagagttagggggtagcttgaaacaatgtacgcaatgcaaggttgaaaagcctacaaccgagttctacttcaagggtagaaaagctgaccgtagactccactccgaatgtaagaaatgctttaacagtcggatgatgaagcgatacgaacaaagggccaaagcaattgttgacatgaaaggtggaagctgctatctttgtggatataacaaatgcgttgctgctcttgagttccaccacatggatccgagccagaaagactttgagatttcaaagcggtggagtatgaaagatgaaagaatcaaagcagagattaagaaatgcgtcctgctttgttctaactgccacgcggaggttcactacaatgaagcccgtggcaagatttacaattggacggaagctaaagtggtcccggcatctggcttttaacccgactatagtgagttcgagtctcacccgttcaaccaattttagtgagtaaatcagataggttctgaggctccctgctaaggagtacgtctgctaacgcggatgtggatcgagaccactgctcactgccaaaataagtgattttaagtgttgacaaactgaatttttcatgttttaatacacttatcagatcaagaaatacttagcgagtagccctgagtaggtcgggaactagtctagaaaactaggccactgtgatgaacggtgagggttcaactcctttactcgctgccaaattttggccctgtggtggaattggtatacacatcagtcttagaaactgacgccgagaggattgagggttcaagtccctccggggccaccaaattaagaatctcttttgctatttggtaagggttcgagtcccttcccggctgctatggtcggtctacggtggccaaatagtgagagagctaggggacatgacgaaggtagcgctgctttccgatctccccggcgctataaaagttatcatgaaggggttgacaaacaagaaattcatgataatataggtacatagagtaacaaacaatatagccggatagctcaattggtagagcacccgaccgataatcggatggttgaaggttcaagtccttctctggctaccagaatttataggcccattagctcagtctggactagagcaagcccctgtctagggcaaggtcgtcggttcgaatccgacatgggtcgccaacaaggtcgttgtagagatagatggctactatcatccggctgtaacccggacgccataggctagaggttcaattccttccttcgaccaccaaatagcgagagcgttaagactggctggcgctgtcactcggctcataaccgaatacaagtggttcgattccacctctcgcttccaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggaggtgatccagtatctcccggaggggcccgggttaacaacctcatgaatttagcccgcgttggccgagaggtttaggcggcggattgcaaatccgtctcacatcggttcaaatccgatacgcggctccaaggtttatattgggatgtagctcagttggtagagcagggagctgttaactctcaggtcgcaggttcgagccctgccgtcccagccaatttccaaaagagactcttcgctttagaagcagagtcgaacgcccgatacgggccttattcatctcctcgtagctcagtctggttagagtgtcggatttggaatccgaaggtcgaaggttcaaatccttccggggtgaccaatttaaagcgggtttcgtatagtctggttattattcttggcttccacccaagagactagggttcgaatccctaagcccgcaccaaaagtcgtagacctcagtaacccggagtaacgcccgggagaagatgtgagttctacgtatacgcgtctgaagctaactaggtagaagcgctgggttgaaattccagaggacttggatcgttaccaagcagatgcaccaaataaagcagttatagattaattggttaaatcgccagactttcaatctggtgttccgggttcgatccccggtaactgctccaatcaagtccaagccggaacattcctccgtatgtgctttcagccggcttggcattattcgtgtggagattgtgtagcccggatgctgcctttcggttgtgacccgattgttggggttcgagtccccgcctccaaccaatgtcgtgcaatggtatatcgcgttgacgcttttaggctctctggatcgtaagccagtaaagcgagaatagcgggctctcgcagcagagcgataggtggttcgattccacaacatgacactctttcctcctcgcctgtgctgaacggtttcctcctcctttcccgtctcacaggctctattccctgccctttaagcatttatggtgatgcaccggctttgtaacccggcgaattctgttcaagtcaggaatggggcaccaattcactatcaaagaacccgcaagctcccgatagggttcacactctataaggttgtagcatggaaaacactaaggttcctgataaaaaactcggaccaatcgcgctagcgcttaaagaggccagagagaatttcgatctcagccctcatgttattggtccaaaatctttcaaacagaaagagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggcggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagatcacatgtaaccctgattacaattcgttccttcgcaaatggatcgagtggtggctagaccctgatacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaacctcgaagccctgccaagggtagaacgtgaaaagctcctagacggtagctggcacgctagagaagagggagctggatacttcacaagggactggtgtcaaatcgttccccatccgcctctacgggtgcttaaaagggtacgtgcatgggacatcagcggtagcatcgaatctgaaaccaacagaaaccccgactggacagccggcgtgctgatgagccgtacaaaagaaggcttgttcactgtcgaggatgttgtcagagagcgtaggttgttcggaggtgttttcgacctcatcctagagacagccaagcaagacggacaagacgttgaaattcaaatcccatgtgacccgggtgctgctggtaaagcttatgctgctcagctaattagagacctagcggatcatggattccacgccagaccgaagacaactaacaaatcgaaagtcactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatctttgggcagcttgattatccctgatttcctaccgcctgatatgactcaatccaacaaattcaaactaaattaataggaggcggcgatggccgagactgaaaaaacagcaccgggtatcccgcgacttcgcctaggcgagattggtagtacaggccttaaacaagtcaatggtactattctggaagaacgccgaccagaacttcggttccctagggcatgcagaacattccaaatgatggcggaagaccctaccatcaaatcagcactcgatctcttcgaaatgatgatgagcagggttgactgggaagttgatctaggagttgaccccgacgaggctatgaaggcccgtggtaaattcctgaaagagtgcatgcatgacatggaacacagttggtactccttcatcaaagaggtcactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagtgccgtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaagaccaagttggttcttactctctggctggtgccaagaccaacatcatggcaatggcgattgaatcgcggctccgcgaaatcaaagacgtactagataacaaactcattcctacgctgttcgcactgaatggtgattatagtccagacttgccgaagctgcaatatggtgagctagatgagatcgacctcgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaggcaggtaaagctggagtaggtaatggtgcatcaacatccgcagccggcagagacaacgccgctgcaaataacgcataaggagacagaatgctgactcttgaaagtgttattgaagctctcagcaatgctttcggggctcccgccaaagcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtctttcatcgctccatccgcattcacaactgatgacggaagagagatcaagaaaggtacatggctccagtggtggcacttcccagaaggctctgaagtggccgatacactctgggaaggtgttaaatctggtgaattcacaggcgtctctatcggtgccagagctacagtcgaggatatcgaatgaccgtaaaagcaaaacgtaaactgaccgatatcaagtttgaacacgaaggtgctcacgtcgctctggtcagtaagcttcaaggtggtgcagccaacgggcacactactcttatcacaaaagctaccaatggtgtaactgaagagcttatcgataaagctgctgaagttacagtcacaatgcagttccctgagttccttcgtaagttcttcgggatgtattatgacgatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctgttgcagttgaaaaagctgctggtgtcgctgctgttgcagaagttcagaagcaactagacgccgctaatgtagagcttacagctcttcgtgaaattgtcaaggctgctgaggcagagaaaaccgctgctatcaccaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaatgaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgtcaccttcgcgtaagcgagggtcgttccagtaaataaacactaggagtaactttaaaatggctaacacccgttcctacctaaacgatggtcagttctacattgccgaccagactgaaaacctgcttatcatcccgaacacttggaccctcgttgagaacatgggtgtcttcacaagtgaaggcgtgactcagaacactgtccagttcgaagagatcgaaactcgttacggtctggttaaggacgccatccgtggaactcgtcaccaagttgctagcgaccaacgtcgtcaactgcgtgccttcgcgattccgcacttcaaccaagacgactacatcactccagaagacattcaaggtaagcgcgctttcggtgctgaccgtgaagaaactctgaacgaggttcgtgctcgtaagctggaaaccatccgtcgcaactgggctaacaccgctgaagttgcttccgttagcgctatcgtaaccggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggcctgatccgtggcgacttcgttgccctgtgctctcctgaattcttcactgccctgattaaccatccgagcatcaaagagttctacaaggcctaccaagctagtcctcaatactggcgtgaccgtctaaccgctcgcggtctggacctgcgcttccgtgagttctacttcggaaacattcacttcatcgaataccgtggcgttgacccgtacggcaaccgtctgatcccggctggcgatgcttacttcatcccaaccgacagcggcgacctgttcgctcgttacttcggcccgggtagcaccttcgatgacctaggaactctgggtaaagaactgtacgctaccgagcgtatggctgaagaccgtcgttcgatcctgatcgaaaccgagtccaacttcatccacgttctgcgtcgtccacagatgatcgttcgcggcactgtgaatgcgtaaagacttcagggaggcttcggcctccctttcgtcgtaggagggtaccaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattgcaatttctttggccgtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtccacgttcgagaacgtcctacgcgatggaaggcagacgaatactcttctgaagaaattgggtaaaatggttgcagagcagatgcaagttaacattgacgactatccgggctctaacagtccggcatgggcagcttacaaaggatttaacgatcctctattccatactggaaagatgcttgagtctgtcaagttccaaatccatcggaggcaataatgctctatcctaccttctccatgaccaactttgtcaagctagatttgattagaagagggcagcccggagacgacggttttggaagacctacccctccagttgagacagtagtaacaatcacagctaacgttcaacctatcgaaaaatcgacagacactcgtatccttccagaggccgacagaagcaaggcttgcttcaaggtgtactccagaggcgaagagattcgccagttaaaggaaggcccgggagggtggagtgccgatagattcatgtgggaaggggagttgtatgaagttatgaaagtcatcaactattcgatgggaatcctaaaccattacaaagcaatttgtatgagagtagagaggaatagcacagcatgatccacacagagctagaaaactccctctatcttatggtcaaagagttgttccccgactggcgtgtaattcaagcttacacgaataatcaggaaccgcaaaccccttatctggctatcgacattaagaggctggatgaactgggaagggaaaatgtctccaatatgagcgatcccattagtccttcgcatggaactattcaagttcaacaggacttcgcagccaaggtcgtattcgaactagttggcaagtatggagagacagcaagtgtctctgacatggcaatggcgattactcgggctctgcgtactccagcaggacacgccgcccaaagaaagttcaatctatcccttttcaaactccccagcacaaaacgagttccaatgctgagagagacagacatgtacatgttttatcaagtgacgtgtcagtttggattctctgtaattgagaccacgactcaagagtttgctgccggggctgacattcacggtgtgtattatgacgccggtcgcccgggacacgttatagagtcccatatcgacataaatttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccaaagtctacaacagcctgcgaggcgttgctgaagatttcggtgaatccgatccgacatatcttgctgctgttcgttacttcggtcaagcactgaagccacgcagcctagttatcggtcgtagacaagttccttctgccaccgtatctgtcagtgttgttcaggaaggccagagctacgttctgaccgtcaacggactaccggtcagctacgttagccagcaagacgacactgctacgctgattgctacaggcctgaaggcagcttatgacgtaactccggtagccggcgtaaccgtcacagacaacgaagacggaactctaaccgttgcttctaacgaagactggagcctgaaagtttcttctaacctgacaatggccgctgctccttctactgaaggctggccggcaactatcactgctgttcagggagaaaacgacgaatggtatgcactgagcattgacagccacgctgacgatgatatcatggcagtagctactcatatcgaagggaccaagaaagtgtttgtcggggctactgctcaggctaataccaaaacttccgcagacaacgacattgcttcgcgtctagtcgctggtgggttccaacgtacggcactgatgtaccatccaaacgctgacgctcaattccctgagtgtgcttgggtaggataccaactgcaagagcaaccgggtagcaacacatggacccataaagctctagctgccgtagatgcttaccgtctaaccccaaccgagtctaccaacctgaagaacaagaacgttaccacgttcgagcgcgttggtggtgtcaaccgtacattcggtggcgctatggccggtggtgaatggatcgacgtaatgattttcgtggactggctggaagcccgcatgaccgagcgtctgtggttccgtatggctaactccaagaaaatcccttacgacgccgttggtgcaacaattctggaatcggaaatcagagcccagcttaacgaaggaattcgtgttggtggtctggctgaagctccggctcctaaagtcttcgtacctgatgttctatccatgtctccgaacatgagagcacagcgtatctttgaaggcattgaatttgaagcccgtctagcaggtgccattcacttcgtacacattcgtggaactgtgaccgtatgaccttgacaagtaggggattcgtggtatcatagtatatctggttctaatcaggtgttttatgagaatcctctacttgtacaagataactaaccgctgcaatgataaaacctacataggggttacttttgatcctaagcgtaggtggcaacaacatcaatacgagtcttctaattgcgtaaagcttcgccgcgcaattgctaagtatgggaaagataacttcaaattcgaagtaatctgctcaggaacggaagagtatattcttgatttagagtctaaagctgtaatagcttatgactccattcaagaaggatataataccatacccgggggtaatcggagaggtatctctctagaagaagatactaaagctaagatatccgagggattggtcaggtactatgaggttaacgagtctgccaataaaggtagaaaagtcgcttcaaggtctgatgatgaacccttgtgtgttttcggattctggtttcccaacgtcaggaccgcaattgaggttctgggcattaacaggaagacgatctactctcgaagatcaaatggcactctccatcttgagtcaagacctttaaaggtagaatctcgcccagctagaggctccgagcaagatcgaaagaatagatcggactctatgaaagggaagaacgccgggcgttctaatggcatgtatggcaaaaagaatcccagccgggcgaagagtgtcagtattgaaggtgttgtctatgaatctatcactgctgctgtaagacatactggttatactaaatcccaaattgagaagcgtctctctaaaggtgtagatggcttcaaatatgtcccataaggagactactaaatggctgttcaacgtctagctacattctctccagccgatgttaccattgttatcactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctaccctcactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttctaacttctcgaacagcatgcagacacgcgattgggttattcatgcacacaacctgcaaactctaatcggcggtaacgccaagctgagcccgggtgatgcggatactcttcgtaacctaggtgtcacactagaccagcgctggctgtaatatagcgcttatgccacatcgacggggagctgccttaacgggtggctccctttgttgtttctggaggatagaaattgattaccacctactcgccgcgtgacgtggttgtaactctcgctggtatccattccgtgacagggtacgcagagggagagtttatcagaattgtaaaagatattaagcctttcatcaagcacggttcgatggatggtgaaatcgcaagggtctacaacaaagaccaaggctggcgagtagagttgacaatcatgcaatcctcgccgaccaatgatatcctttcgatgctttacaacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggcttcgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtactgccggccatatccgtcaaggtatgggaatggggattggtagcgagctagccgggtggggacgcgggtttattcccggccttggtggtgcgttcgctattatgcagcttaaccgtgctaaccaagaactgcaaggtcaacgtctggccatgcaagctgtcggtggtggagtacagggtggtcaagagctacaagccaccctccgcgatatctctcagcgtctcggtcttgacgatagagcaataggtagctcctatgttaagatgatggctgccggacaagcatccaacttcgacaaaacacaggttgatggcatcttccaatccatggctgaatatggacgagtgatgggtctggatggcgaggccatgaaaggctccttccgtgccgtagaacagatgatgggtaaaggacaaatcatgtccgaagaattgaaaggtcagttggccgaacgattccctgcggctgtagccctgatggctaagtctcaggatatgtctatcgctgagctaatgaaaaccatggagaaaggggagcttaagagtgatgctctgatcccattcgccagaactctagcggaagaagctcgtaaaggtggcgctctggacgcggctatgcaaggtacagccgctcagcagggccgattccagttcggatggaaccgcactatcgaggccttcgcggctggaggattcgaccgaggaatgagcgacttcttcaagattgctgcccaaggcatgcaagacgccctaccacttgttaccgctctaggtggtggattcgaagcgcttatgcgtccagtcaacgctctcgtcggaattggcggggaactaggttcgcaatgggagaaaattgccaatcagttcaacttgactggaactggactgacgctgacgactgctcaaactctagcacttctaacccctatgggccgactggtttctgccattagctggggtgcgttggcactggaagacttcattgtcttcttggaaggcggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgctcagggtaacgtcatgacaactgaagcgcaagagcgagtacgagagatcgttagtaacgttcttgaggaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtaaccatcccggctgttatctcaacctctagactagaccctagcagaatctttccagaagttatcactcagtttattcctcctgagattccttctgcaactgtcctccctcaaaagggtgataaagtcgcttatgatattgagcgccaactgatcgacatgcagcgtaatgctgaggtcttcagtttgctggacttccgagacggtatcatctgggatcaaatcgaaagatgcatcttcaccgacttgtctttcactgaaaacgccgagacaggtagcagccttcaacctcgtatgacaatcgaggctgtgacattcacagatactcgttatgtcgaggtgagggttaacaagggtagaaagaccgctaagaaagaaaagagagacaccaaagaaggtgataccggggctagcaatgctaccagccaagactctcctacattcaagcgtagtcaaatgaaagaggctcagattagaactcaggttgcgaggtaaactaaatgagcacgacttatatcgacacacttcctctttaccaagatcggaagtacaggtacgcagtagctatcgagggaatctcaagagtccttcaattttactggaatagccgctctaggcagtggcacatggatatattcgacgaggagcttactccgatcctgacaggactggcggttgttcctcagtacccgatcatggcagattacgccatgcaacatataggtttcaatggctacttcctgctgatgcctgtcaacctagaacaggtgcagtataagcacgatgcgagtgacattgtaccacagtttttcgaactgctatacgtgaacgttgacttggaggatgacgtagagtgaaacaatatgacagagtgtataaactaacgctcggtaacactgaatccgggcaaggtgtagagattacaaacctccaccctgacggaagtttgaacagagagggacttcagttccggttcgatatctctaaaagttcagataacaagaagagcggaaactcggcgactgttgagatatacaatctgtctattgccactctgaacatccttgaaactgaatatttgacgtgccgactagaggttggttataaggagatgggaacttctgttgtgctagatggcaacgttgttgaaacttcgactagaaagagtggcaatgattacgtcactcagcttattctaggcgaagggtacacagcactaacagagaccaagctgaagggcacagtatctccgggcaaaactgtaaaggatgttatcgaagagattcgtcttcaaatgccgggagtggacagaggagcttatacaggcctcaattgcaataacccgatcatgtacggctatcaactccgtggtctggccaaagacgctctaaacagcgtgtgtgaagccaacaatattgaatggaacatcagtggaaacgttctaaacgtcacagacgttaacggaccaacaacgaagagtgttcaaatggctcctctcgtaaacagagagaccggtctgatcgatatcccattctacgccagtgccagcggaacggcacagaagaaagataagcggagacggagaggcgttcaattcaaatgccttctcaatcctgagctaactcccggggttcttgtccgggtagagtcggatagattgtcaggaactttcagaatcaacaacgtccgaatctcgggcggatacagagacaacgaatggtacactgaatgttggtgttccgatcttaaccaagaggatattgaccaatgaggagaacaggcctacaagagcttctgaacctgcactcgtccacggaaggctcgaaacagtatactgccataccttgtgtggtattgcgcgttctggacgattttagacgcctttctgtcgatgttagaccagtggtcaatgacctgtacaaagacggcacatcagaagagcaaccagagattctatctgtccctgtcattatgccgggaacagctaacacccttatcagcttcccattgaatgtcggggatacggtgttgtgtgtattctctcaaagaactatggacgtgtttaaaggctctgccactggacagcctcacactccaaacgatcttcgtaagttcaacatggcggatgccattgccattcccgggctgttcaccttccctaggtcgatgaacgaccctgcaagacatagttggccacatgataccaaagaccttactattgcccacaacctgatgacgggacaagaggcggaagttaggatcaaagccaatggagatattctaatcaacagccgcaagactataagcattaatgctcaaaatgtcaacgtcaagtgcgcttcgctcactgtcgatgcagcacatacaacatggaacgggaacattgcacatacaggcaactacgtgcagactggtggaacttctacattcaacggtattccattccacactcacaaacacggtggcgttatgccgggcggcggtgttactgctgtcccacaagcttaaaggagatcatatggacttgtttgtcaaccccgacacacatgacttggtttttataaatggtgaagctccagtcactcaacgaatggttgatattgttgctcagcgactaaagatcaaactgtacacattcctaggtgagtggttcttggatgataggatcggcatcccctacttcgagaggattcttggtaagtctaggagccttcccgctgttgacgcgatattccaatctgagattatgagagaccccggcgtccttgagattacatcttggcagtcggggatcgaccctcacacacgtgaatactccatggagttcacagtcagaaccacagacaatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgttgctctggacaacctagtgtccttctcggcaattagccggcatgctgcccgtccgacccgggctcaggttgttctagagggcaacatcgacaccgttattaactcgcctcccgctaagatgatttccagcagtacaggccgagtattccacctactacaaggtgtgatcctaactcctaaagcttgctctggtgttggaatcttccctcagacagtaggcaacgacctgacgtatgagcttaagatgtacgttgacgacattaacacaacgtctatcaagtatacaagccctgccactggtacagtaacatccgagtccatcctagcaggattggccgcagacgtagctacaaatcacggaaataccttgacaagctacgaacagaatggtatacttttcatagtacctattgacccattcaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgtgagaccgacgatgagcttcgcgagagatttcgaaactctaaattcgtacaagccaccaacattctggagtccctgatcgacggtctgatgaacgtagaaggagtcgaggatgttaggattatcgaaaacgataccgacaacctagaccccgttcacggagtcccgggtcactcgttccttccaatcgttcttggtggtattcctacagaggttgcacagtctatctggctgaacaagccattcgggattggctctgttggagatacagaggttcaggtggtagacagtctgggctatacccatagagtcaactaccagcgacctgtcgaggttccaatcgagatcaagatcagtgtaacaaacacaggatcgatgccagagaacattgaagatatcctacggccaaggattgtagcgtacgggaccgagaattacaagatcggagacgacgtaatttattctcgattctatgctccaatcatggaaatcccgggcttccaagttaacagcctgacgattgccaagaaaggacagactcaaggcatggcgaacatcgagatcgggttcaaagaagtggctacattcgccgcagcagatatcaccgtaactacggtgtaataatagaaggagaattccatggctgtcaaccaatttgacagagaagactatctggaggtggcccgggaacgggtcactgaacagtttaaagagaagccaatctttgatcgcttcctgcaagtgctgttgtctggtaagtttgatatccagaatgcactggaagacctccagactctccggtctctggacacagccaccgggaagcaactggacattatcggagacattgtagggcgaccacgtggtctagtgtaccaagatattttcaactattttggattcgctggaacagagcgtgcaggttctttcggaagcctgtctgaccctacggtcggtgctccatggtactcggtcggtgctccaactggtaacgccagagagccgagcgacgaagagtatcggatgatcctgaaagcaaagatcatcaagaacagaacaaactcaaccccagagcaagttatcgaagcttataaatttgtattcggggttcctgaagtattcctagaggagtacgctcccgctgccgtccgtatcggcatcggtaagattctaacgaacgtagagtgtagtcttctattcgacctaggtggtgcaggtgcattgcttcctaagactatcggggttaactacacatacactgagttccaagctggccgggtatttgctacagaaggcttccccggaggacaaggcgttggagacctaaacgatcccactgttggtggaattctgaccaacctagtgacataaggagttataaatggctgatatcggtcaactacctattgaaaatatttggtccacaggcggggatatggtagccccgaccccagcgcagcagcaaggcggatggggtattcagtcggttcctcgccaatggtggaactggaaatggaaccttcacgataccaacctagcgtatcttctacagaagggtatcccggaatggaccagcactcaagagtatattgcaaacaaatcgttctgcacaaggggtggtttcgtctacaaggctgttcgtacccatacaggtagcgacccggccaccgctaaccccaactgggcccgagctttcgcagactttaccacatctagctctgcacttggaagcctgacaccaagagacggtggaatcccgttcttcattagtgccacaggagctagcgtgtttgactctacggcttatggtcgtggaatgttgaatgtagctaacgccgcagcagccagaaactatatttcggctcaagaaagttctgttgtactgtctaacctgtccactgtgactagggctgccaacacagtcccgtacttcaatacggatacctccatggctaccttcaacatcacagcgttcggaagaggacttgtcaacgcggctaatgctgaaaacgcaagaaatttcctaggactagctaactctgctatcattacggcagacccagctaacagggcacatactctggtctatagagatgctgctggcaacttcaacgctggcgtaatcactgctaccctgtctggaaacgcaactacagctaacaagcttagaaccccagttacaatcaacggtgtggcgtttgacggaagccaaaacattgttcttccgggcctagatacaagttatgcgggaacggttgcacgtcttcacatcaacggagcgaacctttcgagtgcagataagactactcagctagcactgaggaacaaatctgacaacgactggattagccttgctgtagtggatgacaacattctccagtttgtattcagaagcgctacaaacccagttgtccagattggcaacgaagttatccttcacacaggaaaccagttctctctgggcccgactcttacagacgctaggtctcgtctgggtctcgacagactcactcaaggtagctctgatactcaagtcttccccagcaccttgaacaatggcccctacttgaccgtacaacctacggctatcggaggattcaacggtagcactaacggatggctgttccgattcgacgctaatggtaacatgactcatggtacagttcctgccgctagaatcactggtctgtccaactcggctcagattccagccacaactacggcgcaggctaactctcttgttcagagagacgcagacggaggattcagcgctatttcgattaatgcgtatggcactatcgtcgggtacggctctaacatcttcagtagagcatcgggcactggcaacgcccacatcgggttccagagagcgaacggaacagaactcggtcttatctggggggcccagtctaacaactcgatgaacttccgggtagctggtggctccaccgcagtgtcgattaccggtctggacatgactgttactggaagagtcaatgctaccacactaaacgcctctggaaacgtgaatgcgacaggcaacgttaacgccgggagcgctacgctcaatacagcagggaatatcacaggagccgcttacggagcctatggttctctgaccaactgggttgattcggtatatgccaagaagggagaaattcctaacgatatcgcaagagccggagccgcttgggacgctgtaggtcagtatattctggcgggagatcaatctggaggctctggcggcccgggtacaattagagccgggaaccagttgagaccttactctacgatcagctatacagccggtagcctgcccgctggctcttacagatgcatgggcgcgttcgctgctggcggaaaccagatcactctctggcagcgcatttcttaatagagggctacggccctctttttagaggagattatagtggaatttagaaatgttgtaaagtataaaatgggttacgagtgcgaagtgaatcaccctgattttggatggattccatacttcgcgtgtgactacgatgacactgcgaaagtcgtttacgactctattgttaaagctatcgacgatggcgtaattccagagccagaagacgtatcggacagggatttggaattcgaagcaagggtttggagaaacaatgaactaactcttgcagatcgtcaagtagagattgctatcgacgatgaagacgaagtaagagagaaggcttggcgtaagtatcgttctgcactacgtaaatggccagagcacaagaacttcccatccgaaaagagcaaacctaaagctcctaaagaataaggcgaggtaatatatgccaaacattatgaagcctacgggtattaacgctatctggtctgaaaacggccagaaggttgacccgggtgctgtaaaagttgggcttggatgggtgacagaactacctccctaccaaactgccaacttcattgaatacaagcaagacttgttcaacgcgcacgttaaccagcacggtattcccgaatgggatagcgtcacagagtatcagggtaacctgagctacactcaaggcgctaacgggatcatttataagtgccttagaacccattccgacaagattccaaccgaccctctcaacatcacagcaggatactggcgggtggcgttcgaggatgcaggggaggcggccaaggttcaagctaaccttgatcggcacgtgacaaattacaacaccctctctgggattggtaacgtagttattgcaagacagaacctgagtgtgtatagtaaggccgaaggcgatgcacgttatgccatgcggcacggcaacgggtctaacgtcttcagcgtcgctcccgcaacacagccaactcacgcgatcccgctgagccagctatcgactctcgttcctcctgcgaccgagactgtagccggggttatggcagttgctacgactatcgagacagaagctggagccaatgatgccaaggctgtgagtccgctcaaggccgcacaggtgtatctgaagaagaaagacaacctttccggtctgtctaacgtcactgccgcaagagctaatctaggactgtcggatacagcgactatgccttcttctacattcctgaaggcaggtagcaatctggcagatgtgcctaacaaggcgctggcaagatcgaatcttggaattacaagtagtgctacccagccggaaacctatttcttgaggagcgctcagaacctagcagatgtacctaacaaggcacaagctagagtcaacctaggcctcactgggatggctacaacagaccctgcggcggttatgatgaaggcagacaaccttgctggattggctaacactgctaccgctcggtccaacctagggctaggcacagcttccactagaaatacaggagacttcctgtcgtctggggataacctgtccgacctcacgaacgtccaagcagctagaaacaacctagggttgaagggagcggctacgctcgatgtatggggtcttcctgcgaatacaactgctatggacttccagtctaatcagtcggatatttccagaggatgggctcgactaccaaacggccttctgctacaatggggaactggtcccggtctgtctgatgacacaaggacgaatatccaactccctgttccagcacgaatcttgaacgttcaagtgaccgtaatggggacgtttaacaactccatcggcccgggcgctttcatgacggatatgtggagcaacaccgggtttagagttagctgcaactggggcaactggtcttacccgttcaactggtttgctatcacttccaccctgtaattcaggagtatcaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggcggacaagcggagcacgaacgtctagataaagcagtcaagatggatagagactgcgcacttcaaagtgcctcttggggcctattccagattatgggattccattgggaggcactaggttatgcgagtgttcaggcatttgtcaatgcccagtacgctagcgagggatcgcaactaaacacttttgtgcgcttcatcaagaccaacccggcaattcacaaagctttaaagtctaaggactgggcagaattcgcaagaaggtataacgggccggattacaagaagaacaactacgatgttaagctagcagaagcctatcaatccttcaagtaaatctaggaaggttcctaatgaagaagctattcaaaagctggaagttctgggctgctgtaggctctgcaacttttatggctctggaggccatggttcatctttgggaacctatccttcctcccggcgtattcgccgcagttgccacactggtagctgtaggtgtacgaatctcggcagtgtttgtgactgctagtaaggtggaggaagcgatttcggaaaccatagaagacgataccatagaaaatgatactaactaaactcaaaaactacgccctcgtagtagctgccgcaatggcagcagggtttggatatctgtcgttctctttgtacggcgacttagctgttgcgaagaatgatatccaatctcttgaagctgcgtctcgacagatggaagagcagttccagaaagagcgagcagggtgtgagatcaccactgggagactagaggcgcatatagcccaaatgaagagccgacaggagcttctacaaggccacctgtgcgagcttgagtctctacctaacccaaccccaagggagacccaagaaaatgccacagagacgatctctgagccttctactggggatagtctggaccctgctcttacaagcttgctcgacagggccttctgttccgcagtaccaaacgatccttattgtgcccccggcaagcctgaccgaggaggttaaggtataccgagtggagcaagatacagtcaaggggctcgctagagcttacattctaaatactaacagtgctgccatgtgcaatagtcaactacagacgataaagctatgggcagaagagcagagggctctgtatggaaagtaaagacggcaaagaaggcctaatcaaggtagctacacagggagttatctctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgttatgggttttcagcggacaactcgatgaacttcgtcgaacagttcgttaagcttctggatgaccttcttagccatcttattgcgagctttgttagactctgggctggaatagatcagcttcatgtcgacggcgttgccccagtctacattcccgtcctcgaacaaaactttaacattcagattcatcgagtgcgagtcagtgtcgataactactccaatctgcatgctattggacttttcgaaggtcggcctcggaatgtctatgtccagactaccaaccataacaacctgccctttcttaacgtcggatagttccattaaaacctccttaatctaacttcattagtgtattgaactgatgcctcaaagacttgaaagcctgcggcccgtcgtcttctgctccttcatgaatatgatgagcgattaagtgtatcaatcctcggtctcctagtaacaaagaactaggaatttcttttatccaagccacaaagcaacagaagtgtagaacctccggcatggaagccttgaagctggaatcatccagcttcgataggcgttcatacgtagctttaagatcgggatagcttaactgatatgtagcatcttcgtcaatatgctggtcccctctaactacatactgcaagctcatattacaccttctttccgccttctgcaagacgtgcctctcgcttatggtccgcacgggtcatgttgtactcgatcttctcgatgatagcccctgcaacatccaattcccggacattcgcatagtccatgatacgaatgatagcgtcggccagttccacctcttccatcttccgctctggcaagtgatcgtccatcaaatccttacggacgccttcagcagcttccgcaatttcagttgtaacgagcatcagcatatgcagagcatcacgtttaatcggctcgcctgtgaccagatcggtgttccacttgcggttaacaacctcaagaccagtcatcattttgttaaaaccgctaacaaactcgaagacggactctcgttcgaatagctcgccgaacgtcggctcttgatcctcaacaattgcagtgtggaaaggccactccatccaagtatcatggaattttttgataagctcttgttcgtcaatgtacgagaagcaactctgaccacaaatcttatcgataacttcagtcccgtagtctccgtcccagtatcgtttatcaatgagcttagggtctattctaagggaagtgcttccaacatccccccacgatctccagcctacatgattgtcactgaagtacagcaagagggccagattgtcccgctcttcctgctcctgattctccatagctataacaaacgctggtactttgtctccacctatgccctgagaatagacgaaagaacccaagtgggtggtctctcggctagctgggcgatgagcttcctcgatatgatctttaactctactcattaacttcaccctcctcgcagaacatttcaaaataacaatcgacacaagttagcatgccgtcgtcgcttacaacctcctcgggagggaagttgttcccgcaacattcgcacacaactcgatcaacctccccgcatccccagtaagccatatttactcctccttcagaagatactcattgctaataactttgaagctgaagtctcggctcatgcttttgaaaaccaagccttcccggtacttaccgttcaacgcagactcgccactagccattttaattactagttgcatgtcttttggaacgcctacgtcccacatgtacaccggcacatgtttgaccgtctcaccacccaactggttcagcgtattcagaatggcaagacgctccgctggaagacagtaacgactgtccgaaatgttgtagatatcgtacacatagtattccggtttgtcaactccctcgaagttgccttggatgttcggtgcaaccagttcaccttgaagggcgatattcagaccaaactcccggagacgcttaccaagatcaagctcttcagccatagcagtgaagtgattggagtccttcttaatcacacgcttccagccgagacccttaaagaagttcttgacagccgcgaagaatccgattttctcgtcttccagacggaagccaacatttcgggatgcgacacctacttctccgtccttgtgccagatagtgagagacgaaccgtccaatttgaatgtcacttcaaacttctcgcccttctgatgagcctgatcgtaagccatctgaatattttgtacgcgagcctgatccgtcttcgggatgaagttggggaacccaagcttggaagtgccagtccggtcacccttgttgccgccattgatagctgcctgttcagatggctttacatacttcaggatgcccattcgatcggtaacatcttcgtccactttcggctctggactaccggctgaatgaacaggcacgatcagtccttggctaagctcttttcgaagcttcatggtcttgattcgagaatattcctttccatcccgttcaaccatattacgaccacgtaggaattcaaagatagggttgtctacagggaccatggagtccacttcaatgtagattgccagatcaccggcctgatactcccctcgtttgattacgcactgccaaccaccaacaagcgccagatcgaggctgtcagcgttaggatgggtcttcacatcatcgatacgaactactcgggcaagtacgcggtcttgggaattactcatatgttatcctccttgtttgaaaattggtatattacttgttaaaccagccgaggtcaatagctcgctctaaggccagtagcagattttcagcatctagaaggtcacggatcgcgatccaactgccgctgtctcccggtagaccatctgtgatatatacaggtatgtcgctgtactcgctctttttaagcccgcaggcacaggctacattgtctccgaagacaatctcgctgacttcccttgcctcgtctcgaatatcaatcttcattatgtttttctcctgttgtgttgaaagtcgttgtattctggacggattcctctgctgtgtcaatagccttgacaagaaaataatccgtggtaaagtgggtgacctgctggagagaaatgtccacgtcactcaccggccagcagtatagcgtatgaagaggaaagctgcaagcgcatcctgagtcgaatctgagaacagggcagcgacgacccgaaaggggaaagctcagagcctataaggaacccatgttccccgctcaccgactcatctgcatatgtatatctgcatgagagcgagaggtagaccaaaggcatgtctcaggcggaaaatccgtatggcaagcctagggacaggtctgcctccactaccgatctatctgcatacaagagcttgacaaagctctgcaatccgtgtagagtattctcaaatcaatcacagaggaggtataaatgaaacatgttatttaccgagaagacctaatcgacctgttacgcgaccgtatgaagctccaagctctggaggctggtggcgttgacaactgggactggtatgaggcctcgctaatcgactgcggatacttcgatgacgatggccgggagctagaggtcgaagctcttgcagattgcttcccaaccgtaggtgcgtaaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacccggatgctctaccgggaggatgctaaggataagactcttaggcagtttgctgaggaaaaccctgaaggtcggttctggatcgcggtaaagggtcacgctattgcaatcatcgacggagtgttgtacgatcacactaatgacaagagacgtaccatctggcactgctggcaagtgtggcccggagaggcacctgaaaaaatcgagaggaagcctgatccaatctcacctcctgtgagaaaggccccggactggtatgtctaaacacaaacatctgaagtacaaagaggaggatttatggaaattatttcgagagggacgctccctcaagaggctttgtttactgctaagtgtcaccattgcctaagcattctccgagctaagagatcggaacttgagtatgtttcgttctcattctgtcggcccggggagactgggtattatttcgcagagtgccctgtctgtcacgaagaggtgtctgcttgggttgcggctcctgtcattcctgtggcaccggccaccacggagtatatcacaaaggagcgtaaataatatggaccagttagcaggattcatgggcgaacctttcgtaattgcgttcgactacgacgagacgatcagtctctaccctcttgccttccatatcgtcatggataccttcaggggctttggaggcgctttcaatgtgatcgtagtcactgcacgccaccctgacaacagcggagagttagagtggctacgggactacgggttcccgatctatttcacggcacagaaggcaaagcgaccattcatggaaaatcttggaataaaagtctctgtatgggttgacgacaacccgttcagcgtggataatgaccttcctccgtggacagtggagcaatacgatgcctacatggaggcaaagaagcaacgagctatcaacagagggagtaaagcatgagcgagattatgaaggttgaagtgggagatcgggtggtccttaaggcctattgcgatacatacactggatgtgcaaagcgatgggcgcaggcgcatggtcgtttggatgaactgctggctacgggatttgtagaagatagctgggtacattgtgatgacctcgcaggaggcttgaaaggtactgtcgtgatgactgaactaggactgaaggaagaatgttgtgcagtacgtctagacgcctacaccgacaacagggctgttgtagttgtcgacgcttctgatctttacatcgcatgcaaggcagcaaaagctcccgtaagcaccctagacgaggccttcggttgtgaccacgactaccttatggactctccggctaacgctcagcgactgaatgagtctgtcgagcagctacggactggtcaagtcgtagaagtggacgtgcctatgagtgtaaagcaagacgaaactccacctgtcgtagtgcatgtagtagagaagatttacgataggaaaggtaacgtacacctcattctacagtatgaggtagcaggggcgttaatcaggacggtggttgaacagggagaactcatttacttcttggatgaaatgcaaggtatgtacttgaccaagattcaactggaggtgaacgatggagttgtatgaccagtggcgtaagtatattagcgttgtaatcttagaagaagaagataatgagcgtcagtgcatgcggcttattgaggcagttggcgaactcgatccctatatccaagatttcctagattctctctctattaaaactgaaggaggtgtgtaagcatgagtcagagtaagcgcgatgagattgtagttgaagcacgtgggctagagagctacttcatttcccactggaacggctgggatgtgatggacactgcttgtctcggattttatatcaaacctgagtatgttcttgacccggatattcgagagcttgagcctagcttcttggagcttgatttcgagcgttgccgtttccgattctggggaaatgaagacgaaggcgtggacggcaaactcatggagggcaagttgcagattatgaccaactccttcgagtacgtcttcttcaaggaggtttgagtggctagacagacttacgagtctgcatcagatagggcggtcgaggaggccgtccgttctgagcttgaagggcggtggaagtgttctcttcataagctacctagagcccactatatggattgggcagcctgccggaatggaaaggttgttagctttgtggagcttaaggctcggaataatgaaatgcagaaatatccagacttctttgtgtcccagatgaagtggctccatgggatcgaaatgcaaagggtgtttgacattcccgcattccttgtggtaaagtggacggactatacaggatatgtcaaaatgacagccaacggcgtcaactacatgagcatgggtggcaggattgaccgtggagactggcaagaccaagaagttatggtccatatcccgctgaaagacttcacacgtttataggaggacaaatgaaacgactctgctaccgttgtctgcatcttggagagcctgtcatgctccgtcataagacgggcatctggtataagggttgtagtaaatgcggatcaggagtattctatggctaagaagaatcctgtgttcaagtttctgaatacagtaaacaagccctcagtagagagggataaaaccaaatacaggcggaagcctaagcacaagaagaaggagcgattaaatgaagaagggtgataaagtgaggatcaatgacgacgctgataccatcttccggggccgtgttgccactatcatcgcagtagacgaagagggttgcgttattgatgtgggcagctacgaagacgaaagcggagagcttatcgagtaccttcacctgttcttcgagcgttctgagttgtccaagcaggtgtaggagggtataatgaacggacccgagtgcagatggtgcggagagaaaactgaagctgagtttgtagacgttgggcttggatggatgcagcaagtcactggaggcatgtgtcaccagtgtggagggtatgagaacggtcactaccagaacgacggaaggctctccgaggtcgagtttgccacctactggagtggtccgttcgaagattatgcggatttctcgccattcaatcatatgagagaaggcgactcgccatgaaggctacactgagaaaccacaatctgctatacatctacttccacacgttctcggaaatgaatgagtggttgacagagaacgctgtagatcaatggacagtcacgactctgggctccggctatcaggtggctgttcctatggaccgtgcaatgcgggaccaatacgtctcggagaggggttgacacgaacacaaggtgatgctaaactccgtggttgtctgaagtaaggaggttttatgtccaaaatgaccgtggcccaaattgcggctatgcacggtatcgatttgtattctgaccacaagaccgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaatttcgtgggaactgaatttaacgcagagatcaacgctcaaattaaagagcagtgctcgtatgatccgcgtggttatcgtggcctgtccaaggaaacttgccagtatttcggagtgctacatggtttcgacccggagactggcgagattgcaactcagctatatcctactactactaattatgaactcactggctacaaacagcggatcatgccgaagaacttctcagagcctatcggcgagaccgggaaggattgcgagctttttggtcagttcaggttcaagaatagcaacagcaagaaggtgcttattgtaggcggtgaggttgaccagctatcagcattccagatgctcaaggagtatgatgaccggcgagcaggcggtaagagtgattatgaaccgactccagtggtcagccctactatcggtgagagtggggcatggaagcagctacaggctcagtatgagtggctagaccggttcgagcaaatcattctctgtttcgacagcgatgacgcaggacgagaggcagcagacaaggcagccgataagcttccgaagggcaaggtgttcatgatggaaatgaaccgtaaagaccctaacgagtatttgaaagctgggcgtcaatcggagtttgtcagtgcattctatcgagcccgtacatggacccctagcggtattgtagggtctgatgcactcgacgctcgaatgtatgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggtgagaaggcagacttgtacgagaccgttgaagagaaagtggcgttccttgatcggcaccgtgacgctcggtacgacttgtggcacaaggaagacggaagcccacgcttctatctgatcgatgaccgagacggaagcctagcagccctcaaggctcaaatcgaacaactgattattcagtttgagtgccgtgttattattctggacccgcttcaggatattctggacggattgagcaacgaagagcagtcggtattcatgcgctggcaaaagggtatgaccaagagccaccgagtgacgttcatcaacatcaaccacgtccgtaagagtggtggtggtcagaaggctaactcggcaggtgctgaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggaatgatgggcaattggtactacgacgttgagactcatacaatctgggacttggacgactatctggaccgataccctgacaagcgccgtgaatacgaggcttggatggctcagaaggaagaggaaggccgggacacggaatactaaggttgacagaggggtgatgcttatgtatcatccctttcgtcgtttacaggaggaaaggaaatgcaacaacgatttgaaacaatcgagcaatacctcgaatggatgggaaataacaatgtcaccaacatgacttgggatatcgaggccacaggcctgttggatgaaacgtctatcgattacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtggccaagcgtcggatcaagcgcgtagtggctcacaacatgattaacttcgaccttatgtcgatgaagcttgtggaagatatggacttcactatcggcgtagagcacagggatggcggtctgactacgtggtctgctgacacttggatgggcaagcaagtggtattcgacgataccctcgttatctccaagacttgtaaccctgacctgttcggcggtcacagtctggataagctgtctcgtcgtgcaggtggtgacaccaagattgacttccgtaagcatttggcaccggatgttcgattcctcgacttcgcagccgatatgctctactactgtatctatgacgtaaaggcgaacaccgctgtatggcattggttgcaggaccacgaagattaccaactgtccgaccgtgacaactacatcaagaattggctgtccccgattcagttggagaagaaggttgcagagatcatcacctatcaggagcaccgagggtttgttctgaatgttgatctctgtgaaaaagctgtgaaagacttggacgccaagatggaagagcgtcgggcccgggtggaacctgtgcttcctcctcgaccggcaaccaagaaattcatggcagactacactccacctgttcgacagttcaagaagaacggggagatcaccacttacctacagaagttcattgaaaagatcggcgctcaattgaaagagggcgacgacagaaccatgatctttgagggtaaggagtacaagctgcctctcccggcagacgtaccgctgaagacggaaatgcctgctaagatcggggacacaactcacatcaagcaatggcttatgggtgagtttggttggattccatcagagtggaaagagactgatctgactgtggatcagaagaagatcaagcttccgatggaaaacatcgttgctaagatcgatcgctggctggatgtaacgtatagcacagcgtacaaggaagagcggctggacgggttcggggattacatgaagatcacccctcgcagcacccgcgcgtatgtacgtcagaggttgattgatcgtgcaagcaaggggggctgtaaggttctcactaaccctagcttcacaaagggccaagagaaagaaatgtgcccggacctcgaacgcattgctgaacagttcccgttcgccaaggatgtgattgagtatctgacgttcaagcaccgtcgaagcgctattctcgggggtggcatggactgggatgagatggaagaaggagaagagccggagaaaggctaccttgcaagtattcgtcaggatggacgtattcccactcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatactgtaagtcactcatgatggagaagccattcgacgttcacacgatgatggctaagcgtatttccgagattatcggtcgtcaatttaaccggtctcctgcgaaaaacgtaaaatacgggtgtacgtacggtgctcaagctggtaaagtggcaaaaaccattggtgccgatttgcaaacgggtcaactggtattcgatgcgttctgggatgcagcattcccattgaaagcactgaaggatgacctaaccaagcagtgggaggccaacggtaagaagtatattgttggagtggacggtcgccgagttcctactcgttcggctcacgctatcctgaacagcttgttccagagtggcggtgttatctgtgctaaacgtgctatggtgattcatgaccaactgctggagaaagaagggttgaaggtagacttcttcaaggaagactggaagaacaagccggaattctgccaacaaatgatcgcgtaccacgacgaagcgcagttggaagtaaccgccaagtcggtgagcttcaagatgttcccttggtccctagtaggcggcaagccggaaggggagaaggagcgagaggcagccgagaaggagttgaaagctctagctcaggcttacaaggacgaacaattggctagcactggcaaggtgtggagtgatatcgcacactacagcaaaggtgaaggcggggtgtttgtagcttactgccgcgctggagaacttgccacgaaggccgtgagagctgcgggagagttctactctactcctctggtgcctatcgagctgaccgctggctacatcgttggtcgatcttggaaggattgccactaaaactggcattaagcgaggaaaggggcttgacaggcccctccgcctcctatacaatggccacatattcacgacatacagaggagaaaactcaatgactctagctttcgttatctatctcgttatgaccgtattcccagccctgtctgcggcaggtcattttaccctgatcgtcactatcctcgcgtgggttgcaggagggttcgtttacttggcatctattggtggccgagaaaatgcgtcagttaaagccacactcaaaaatcacctacgacccttgacattcaagctgtttctaccgatcattgtaatcggtcatctggtcccttcgtctgagacggcatggtggatggttggcgggtacgctgcacagagcctctatcaagcggacgctactcagcaggttctcagcgaatctactgaactgctcgaagctctggttaagcgggctaagaaagaaactctgaaagctgtcgaaggcagcagcgagtaatcacagaataggaggtatgtatgaacacggctcgactctacgtctacggcaaatcgtctatggtaggaatcactgttgacaacaaggccaaccgagagtactatacctctaaaggcttcgaggtatcggagacaccgttagcccataaaagcgtggctaacaaatacaaacagaaaggaggtaaataatatgtctggtgttattcccgggactatcgtcaaactcactcaagtgggatgtgacgtcaccgttggctggccaaaggaagcccgatatgtaggcgcatacgcagtcgcagtagatggacgcgatatcggtctcccggaaggggaaatccggttctgctccctccattggtccattgaccgagacgtcaatgatggacttggagactaccaatcgatgctcgctgacaacgaccgcttcgaaattgtagcgatcccgggtaagaagtactatgttaagagcgctgccgagcgcccggacttgatctcccactacttggttacttcggaaccagctttgtacgagggtttcgaaccgtgctggctaaagagcatgctcgaaggagagagcccattctgcatgctctttaaaggacgagttaacatcggcggtgatatttctgacgatccgaagctccagactctctaccctgaattggtacttgaggagttcaaagaagaggcagaggaggctattgaagctccggtcaacgaagagaagaaagaaaaggttgcaaagcccgctgtaatgggttatgctgttctcgatgtagacggattcccgcttaagttcaccattactcgcgaagaggcacggtccactaagcgttggtggggtggcaaggcggaaggcgtctcgattgtcaaactgattaaaggagaggaggtgcgctaatgcgctaatcctcttgcagaatccgggaatgtccggtatgatcgtcggtcaagtggctgacacactcgcccagtctagggtacttaaataggagaaataaaatggcttttaaactgaacgtaactaccaacactcaatccggcaacggcggcatccgcaaggaagtcgattgggatgctctgaacaaccacgtcgtggaagctgctggcactgccgctaaagcacgttcgatcccgggttatatctccggcatcatcgacctcggcgagcaagagcagaacgatgcagaggttgtgttcactggcactgccgaagatgaaatccaaatcatcaaggaatatccgaacacttacttcaaggatggactggacaagcagactcgcaagcctgtacgtctgaagtgctggccgcagcgcgatatgcaacaaatcgcgatcactgtggacttccctcagatcgaggtagacaagagcctgtacctgaccggtaacagcaacaagtctccgcttcgtgtcctgtacaacggcgactttactctgccgggtcagaagactaagattgttggtcgtccgttcaccatcaaggaagtgaagcacccgaacggcaaatgggcgttcgctaagaactccatgctgcacaaactggctgtagctactggcgtcatcaacgaagacgaactcttcaccaaggaccgcgtaggcgagcttctgggtaaagtggctcagttccaagttcgagtgtggatgaagccgggcaaaaacgacatgaaattcctcaccgaggatatcagtctggtcggtatggtgcctgaaggtgttccggtccctgaactggatgagaagtacatctacggcgtgaacctgtatggtgagaacgacgaagaggcagttaagcaactgcgtgccaacgtcatcaacaccatcaagcgagccaagaactacgaaggttctgatatcaaggcgatgatcgaagctgttgaagctgcacgtggtggcaaccgctccagtggggatagcgaggaacaagctgaagctaaagaggagaccaaagctgctcctaaagttgagccggttcagaccaacgtcgatgacgacattccgttctaaggttacgcggaagtagaggtaatagaggtaatagaggggcttcggcccctccctttcaaatttcaaaggaggcaatcaatatgcaaatcaatttcggtcccatcttccttctggctgctatcgtactgtgcgtactgaaatctgctggcgtgctcgctatctcttggaccgtggctctaatgcccatctggattcccttggtgattgttctatctgttctcctgctgctgcttgtagttgcaggcctgatttacgcattcggggatcgtagtcaactaaacttcgcctttaaaaagaactacagccttaaaaagaactttcgaaataagtgaggactaatgatgagcaacttggttattgttcgagtacctgagtacattctgaaaggccccgcagtacaaaatcagtttagcggtgaggtgtgggaacgagagcttttcaaggatttgaaagaagctgcgaaaagtatcattgaaggagagccagcttatgttgctcttcctaacaaggtaaaccctgatactcggcaaacagagtgggacattaaggttgtgcagttctaacccaaggggagcttcggctccctttttcattggagataaaaatgagtgaaaaggaagaggatatcgtcctcattgacggcgatctaatcgcctttaagtgtgccagtgtcaacgagactcgatccatcattgttaaaaacaaattgaccggagaagaagagacttggaagaatcggacaacttggcgggagaataacaaggatgaagaggggttcaacgaagacaacttcgaaattgaagaccatcaagaccccaagcacgtatcctatggtatctctgttgttaagaccatgatcgaccgaatctgccgccaagctgggtgcaagcagttcaagattctcctatcaggccctgataacttccgtgacgccatcccactcccgaaagaatacgagattaccaagggtaaaaagaccttcactcgtggcggcaggtacaagggtaagcgtacagggcagattaagcctcttcagctaggtcagctaaggcagtatatgatcgaagcgtatgacaccatcatccaccccggcgaggcggatgacttgatggcggagatgatgtataagaacggcgtaagctactccagaggggagaccactcagcgcgtgatcggagctaccatcgataaagacgcagacggcactctgggatggctttgcaactacgaacgtgagcctgttcaagtcaagttcatttcgggcctaggatcgctctacagggactctaaaggcaaggttagaggagagggtaggaagttcttctacttccagctactattcggtgaccctgttgactgttaccgtccggctgacctgtgtatcgggaaggacttcggggaagtggcagcgtataacatcatcaatccctgcgcaacggacaaggagtgctggcaagcgatctacgacacctacaaagcgtggtatcctgagcctgtcacctacacggcgtgggacgacacagagcacactaaagacgctgtagagatcatgcaaatgtactgtgactgtgcccacatgcaacgctgggcgggagatagagtagactgtagggctgttctggctaaacttggagtagacatgggaggtgcagaatgagcgtaaggcctcgcccttgggaagacttcccgggcatctggaagaccgaagccgcgttcttgagttgggtcagaggtggcattcgccgctacctttggtctaagaacccagtcaagcttgagtttgctaaatcccgaagaatcaagatagccaacaccaatgaaaagagcaagctcaggaatcccactgtatggggctacgtatgcgagcagtgtggaaaggaaactcctcaagctaacgtcgagatcgaccacaagacgggagaattctccctgaagcgagtagaggatatccaatcgttcgtggaaggtgttgtgtttgtccgaatggaggatttggcagtgctgtgcaaaccgtgccatgagatcaagacatacgccgagcgctacgggctaaccctcgaagaggcggatatagtgaaacaggctattgcaatccagaagcgaaaggggtatgataaggtcttcttgcaggaagtgggaatcaaacccgcatccaacgcagagcttagaaaagagcagatcattgaataccttaggtctaagaaggagggtggatgaacgaggatcgggtttacattgtagtaagagacgaggcaccagaatacatggtgcctactctggttgcacatagcatcctaggggcagacatggcaatggttctcctcggacaggaccgggccgttccatcgacggaccttccgtcccgtccgtatatgcatgcagcggcaaaaaccgccattaagtgggtggagtggaaacagtggagcttccgtaagatcgttgtacgagtttctgacaaagagtacaataagatcaagcaaatccctttcgtatatgaggggtatgagagaaccatctgcaacggagagggttcttgtctagtagtgcctcctcttagcaaggaggaaaccccgaatgttcttaaatttgcaaaactatggaggcctatgtgagagaggagtttattaaaatcatgcgaaagctgccaatcagagtacgagcttctatcgtcctgatttggattgctctgttcttttggctgccggttgtaacagcgctcgtcgccggagttatagacttcttctataccgcaaaggatcagttggaagagggatactcggtactcatttccgctgctaaaggagccgttaaatgtcttcgtacaggagaggagctatgacgagtcttgctacatatgttattcgccacaaaaagactaaagagctttggactactcctaaagggaagcggcaatgggcaacaaaaggggctgcggctctagcttggagaaacgcctatgagggaactacactgggcgtatgggctgctaaaagggacatggagcgatggtccgacttgaacattcctatgatagtggagaatgggtgctaccgtttggctagccgagaggccgcagctttcaagagtcaatctgctttcgagattatcgatatagctgaatctctgaagaatgagaatcaattggtactcgacttgctgaaagacgttatcggatttgaagtgccagactccgttggagacggatacgttcgtctagctattaaaacatccacatatgatgatatcatcaaactactgaaggagacgaaatgagcatgatggaccctaaagcatacttcatcaaacaagacctagaggaagccacaaagctccttgagagggctcacaatctactcgacaacgttcattgctatgatacagatgtatatgaggatattgcagcgttcctttacggtcgagactgcgaggaggcagagtaaggtgcagaaagacattaggaaaactacatcggagcttcgagatttgtgtgaagctgtctctatgctagacgaggccttggttatgatgcagaaaaacgggctttatgatacagacttgtacaagcgcatagacgcatttttgtactaccagccgggagaaggtgaatgggaggttcttgaatgagtagcaagaaacactttgtaatttctgacactcagtgcaaaccgggtatcagcttggactacatggaagccatcggtaaatatatcgtagccaaacgtccagatgttgtgatccacattggagatcactttgacctagccagcctgtcttcctacgataagggtaaacgctcctctgagggccgtaggtactctgaagatgtgcaagtcggacgtgagggtctggaccgactgttcaagcctctgtgggagctacaggaacgtcaacgggctaatcggaagaaagtgtaccaacctcggttgatctttacactgggtaaccacgaagagcgagcagaccgggctgctaatgacaaccctgagttgtatggcaccgtaggcagcgatgagcttggtattcaggactacggttttgaggttgtcccgttcctcaagcccattgaagtagacggaatttactacgtccactacctgcaaaaccacttcactggtaagcctctgggtggtacagcgaacaacatgctcaaggctgctggtcattcgtttgtcatgggtcaccgtcagcttctggactgggctatccatcctacaatcgacggaaaacaaagacttggcattgtgactggagcgtgctatcctcacgatgaagcctacaaaggctatcagggcaacaaccacttccgtggctgtgttatgattcacgaagtgaaggatggttttggtctacctatgccagtaagtctggacttcatgatggagaaaggaggtttcaaatgacggtttataaattctggtgcgaatgggatatcggtattaatgaatgcctgtggcgagactactaccagatggaagaggatgtagctaaagccttgtcagactgcgggattgaggatactattgaggaactagagggtgcaggcctgcttggcttcgactctgttaaagtgattggttaataggagggcatatggctgagtttttccttggggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggcgctattttcaaaatcgaccgcaaatctaaataatcgaaaaggagatataaaatgactgatttcaacatcacccctgagcaaatggaagaagcaatggcaggtatgaacccggagcagcgggctctggtagagaaagccttgaccgaccgtaaatctctggaagattccatcgtgaccgaggacggtgaactggactatggcatgcttgcacgacacatccgcaccagcttgggtgatctgcctctggtaatgggcggccctgacttcctgaagctgatgatcttggttgctgcgatgccggagaccaaagacgatctcctgactctgcacatgaacctgtccttcattctggactgcattcgtgaatcgattagcgacgaggagtaacaagtggaagagattgtaaaagaagacctatctggcgacgatctcatggttgactcagcagggctagatgccctgctggccttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcgacgttcatgctgggcaaccgatttctctggtgcaacggtcaaagaatcctatcaatattcaatattgggacgccgataccatcccttacggcacagtcttggttgttaccgaggaaaggggtgatatacgaaagggagaattggtcgtaaggctggctagtagtgcagatgatgagcactctgttagggtatgtagattctctgatttcttcctcctaatggagaggggttatgacgcagccagtctcggcgacgttaaacaagcgtatgatgttctgttcgaagatcacccagtgactacctttgtcaactgggatagggctcagcctttgacaaacagtgagcgctactacggagactttctgattggcggcgaccctaaagggatgccactattcaacatggctgttcttaaaaatgttctgtcgccttacactgccgacgatgaggaactttcagctatgaccgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaataaccctactacgaaggccaacatgccgtattttgcggagtgcaacgatatcatcgaagcgctggatatgcgattcggccaaggcaacatgttcaaagcgttgtggcgggctgcggcagcacagaacctaggcaagttgaaggccggtaacgatgttatccgggactacgagaaagtcatcttcttcgctcagttggagatcgataagattctcagagaaaggggttgacattctccccgaggcttgcgataataggctccaagttgaaacgaaggaggtatgtagatatgatccagaaagtaaaacagaagctcatgatggtgcatcctgtcctcgctagcgagatcgtctggtgcctcaccttcgcaatgcttcagtaaaacaagggagcttcggctccctttattgtatcaggatttaataaggagagtttatgcaaatttctgcaaaagtgattcaacatagctaccggattgggagtggtacgaagaatcacagattcatcactacattcgaactggagtatccccggtttatccatagcgagctaatgactcaccgtctctttagtcgaaatgcagccagcagccgggcaatccctgtagcccatatgatccgccaagtggaagaaaaccctgctatgcctgtccactggggaatgaaccagccgggtatgcaagctgagttcgaattgagtgagtgcttgcagcgtagctctcagtacctgtggaagaaggctgcaaagagtgcagctaggattgctatcgcactaaataaaatgggactccacaagcaggtggttaaccgtctacttgagccgttccaaatgatgaagactgttgttaccgctacggaactggataacttcttctacctgcgttgccataaagacgcacagccggagattaaggttctcgctgagaaaatgtatgaggctcttcttaaagcgggcccggcggaggctctgtatgacggggagtggcatgttccttatgtgactcggttccgcataggggatggtaaactgcgttacgcagattgcaatgggcaagaactaagtgtagaggaggctatcaaggtatccgctagctgctgtgctcaggttagctacaggaagaacgacgagactctggaaaaagctcttgtaatctacaaccgattggtagatactaagcctgttcacgctagtccgttcgaacaccaagctaaaccgatgctggagcctcatttctggtgcggcgattgtcaacaacagccggattgggaggatggcgtaacgcacgcagatcgagagggtaacttctggtctggtaacttcaaaggtttcatccaacatcgtcaactaattgaagggcacgtttgcaacgagttttacggcccagagaaggaaggagtttaaaatggcagaatataacctgagtctggaagacctcatgctggtcgatggcttcaaagaggcgttccagagtaataatgaaaaagtagtacgagagcacctgtggactaacggcatggatgttaaaaactactcttatgaaatggttttctgtcagcatcgcaccctgattggccgggtagtagagggtctacgattctccggctttgagcgtaccgacaaggagtggttgagcctcggctgtgcctcgctggaagctcacatcgcagcgtgtgatgacagcaatctacggttcactcttcgcaaaatgcgtccagagggatcgacagaggcaacgttccacaattaatgcagtagcagtagaaatagggagtgggtatggaagttacaaaggcgctcgtagacgaggccgatattttcaataagatcacacaaatcaggactccaacggagtcctatgcccggaaatatccggtcattgtcgaactagcaaaccaacaactagaagagaagttgtggttctctagcgaaatgaaggtagagctggataagttgaacctgaagtttaagttggaacctcatcagcttcacgctgtaaagactgtccttcaactgttcctcaaatacgaactgatcgtaggtgaggagttttggatgggtaaagtagtccgaacgttccctcgcccagaggttaaactagcggcttcgatcctgtgcatgatggaattggcagtccacgctgaattctacaaccagatcaacgtagtgctggggatggatacagatgcggactatgtagcttacaaggacgatcctgagcttatgggtcgaatggattggctagaatctgttctaggtgatgaagacgatgttctttcggtcattatcttcagcctcacagagactgccctcctgttcagttctttcgctatcttgaagagcttccagtgcaacgggtataacgatatccctgtaatcgcacgcggagctaatcagagcgctgtggatgaggacttgcacggtgtagtttcggctgagatcatcaaccaatactacgcagagattgggcgaccattgtccgaagacacccgtcgtgtcgagaagattcgacaggcaattgaccatgtgtatgcccacgaatgccgtatcgtagacatggccatcccgggcggagagcttaatggagagtctgcggagaactacaaagcgtttgttcgttatcgtctgaacgtctggtgccgtcgtcttggtctagaagatcacttcgagaatgatgacactccgattaaagactggttcgaaatgaacacctacgcttacaagatgattgacttcttcactccgggcatgggaatggaatacgaactaggctgggacgaagaagagctagcaaaggcttgggaagaggagctaaaatatgagtaagagagatacattcaactattccgaagctaggaaaaatagccaagcagccggcgagactcctctatggtacactacggctggctaccagttgttcatgaagaagtattcgaacgagggcgagtctgtacgctctcgcttccaatctgtagctcgcgctatggctcaacacgcgcctatggtatacccggagtggtggagtcaagatgagtacactaaaggtaagaactgggagcaggtgttcttcgacgttatgtgggatggctttgttagcccatcaactccgcttctgtcgaatggaggcctacgcaaaaagggcactacggtatcttgtgctggtggtctgatggacaacaacctctatgaccgttacaatgtaatgacagagatcgcagtgctaacgaagcacagtcacggcacaagctttagcctgaccaactggccggcagaaggagacgctatccgaggtggtgagtctcaaggtgttatgcctgtcattcgggacgttatcaacgtcatggaagaggtggcacagggttctaggcgtggtagctgtgcatacagcatcaaccctcgccatggggacttctggaacgttatcgatcacctgtacaagcgtacagaatcgaacaacgtcggatggcttctggacgaccagtggtgcaaggatatggccgagaaagacccggagaccttgaagcgatggaagcgaatgatgttcgtcaagctggctagaggcaaaggctacttcacgttcatcgacaagatgaatcggcaccttgcagaaccgtttaagcgggcgggtctacgctgcgaagcgtccaacctttgtcaagagactgttctcccggcaaacgactggtatacttttagctgcgttatcctgaactacaacctcgaactttaccgttcttggcctaagcaccttgtgttcattgggcaggttatgtctgattgcaacatcagtgaatacctagcaaccatggatgaggtcagcgttcaggaccgccgagcactggagaagatttaccgattcaccaaggacttcagggcgcttggtagcggtgttctagggttccacaccctgctacagcgggagcgattcccggtcggcagtatggatgctatgttcctgaacaacgccatcttcaagggcatgaaggagcaagctgaggcttgcaacagttggctagccaaggttctaggagagccaacggggtgccgtggcctagggaaacgtaacgccactacaatgatgatgccgccaactaaatcgacggctgaactcatggcgggggcttctgagggtatcgggctggacgtggctatgtgcttcacgaagcagagcgctggaggtgaattcttccgtgtcaacaaggtgttgctggagattatccaagagcgcggcctagactgggaagagtgcgccagacagatcaacgaacgtaagggaagcgttcagcacgtagattggctaaccgatcacgaaaaggctgtattccgtactgcctttgaggtgagaatggaggactacctgcgtctgtgctctcagcggcagaagtacatcgaccaaggacagtcgatcaacctctacttcacgtcgaacgactcgccggcttacatttcgtacatccatcgtctcgccatggaagacccgaacatcctatctctgtactacatctacagtatgagaggagcgggggatatctccagaacggaagaatgtgaaatgtgcatgtaaaatcattggcccggggcttgacagcttccgggcctttgtgtattctgagcacatcaaaacgaggagggactaaaaatgaacaaattctctgaagtgtactacacttggagcgcagcgtgctctcgtacaaatatcttgatagatatgggatggactgctacaatccgtcgagacttcactggcgggatcaaccctgtatgggttgtggagttcacccgatgaacaacaaactccgtaaagagttcgataaatggtggaaacaggatgagcaagaagagcttcgtaaatcctgtgccaaaggctgggccgagtatatctggatggccagtcgaagcaaagtgaaggtgaagcttcccaagccagaaggggagttgtttactaacatccaaatgcatacaattagccgctgcaaagctgctatccatgaaacaggactggaggcattctgatatgaaacaacattttaaaaagcgactaatgcagaccagtgaaccgttcgattcagcgacgcaagctatggacgtagcgattgcgtggggaggggctaagtactgcgaattcacttgcgtaactgcggataatcgcgtcatcagcatctgggagtacaatgacgtagagcctgataaaccggtattcaatggacagcaacgaatcttagttccaacttttgaggaggtagtataatggaacaaactattgataaatctcggtatattgtgcttgataacgaaggtcggcacgttctgaccttgtgcgagaaggccgcctataacctgcttaaaggcgttcagtggacaaaggacaagcatggtcaaatccatgtaaatggtgtcacaggcgttgaactcggagttcgtcaagggattatcgctgaagtattcctgtatccgggctacatcatcctagaagaggtagactaatggatatgttcgataaatacatgcaagttatgtatgaccgggacgctttctcaaggcgagtcggtgagttagaaaaagaggtagccgaactcaaggctaaggtggctatcgccaagtgtgatatgcgtgtcgtgaaaaccctactggaagatatccaatgggtgtatcaagatgaagctatctatactctaccgggctacgtttgcccttgttgcggggaatctgcaaactatgggcatttccaaggcagcttcgataagagcccctgcctactagcttgtgtactgagccggagtgaagcatatgaagcctaatgttgtagactcgctaggcattaacatgtgctacgcctgcggaggtaaactgtacgtccgaggagtatgcactatctactgccctgattgcgagaaggcaacgaaagataaaccgttcgtcaggatgcagcttctacaggatatcgaagacagcaagagggttgacaacgaatagaagtgctagtaagatggccacatcagacagaggaggagccatggctacaacagagaagatcatcgagtacgtctcggcctgtatcgaacgcttgcaagaggacgtaactgggtactcggagaacttccgtgacagggcgttatctaatcgcacagggtatattcacgggcttatcactatggctgaaatgaaccagcaagtgagtatcgaggactgcgacaagctccgtgtaaagcttcgtgaagctgctgaggctgtgttgaacgtactggattccaaaattaactaggaggtgttctgatgaatatgaaagagattgtgcaggctttgattgtcgttgtcgctctgactctcgcagcaataggttttgtagtcgggattactgcgttggccaacaagagcgcgcctgccgaggatattgtcgtgtctactgaagacggcaccatcaatctcggtcgctccgtgaagagcgagaagctgctgtatagcatgtgcatcaaggtagaagaccgcaaacctgcttgtgaattcaccaccaaggaccgtgttcttagcgaagtgaaacaggttatgcgcccgggcgaggctacggcccgcgatattaagattgcagtaaacgcggctgtgacgtatactggtgagaacgggcaggaagcaacctctctgattaccccgaaaggtaggtatctcccggctggcaccccgtctgaagtacatattcaggctattgcgaatctgttcgacagcgtgtacaatgactacaaacaaaacttcagcaagatgtgaggaggactcatgaaagcacagcctaaagaagtagaaaccctgtccctcgacaagcgccccaaggcaggtgatgttgttcgactgcgatctgacggtaaaacctacgaggtaaatgctgtatatcccacggcagtgggctgggaagcgattctccgcaacatgtacgacaagactaagaccgtcactgtcagcatggagtggtgaaatggcaagaaccggcaagtgcgtaaacttcctacctgtcacgccggacgggcgagtaatcgtccgattcggcaagaaaaggctaggctggcttggtaaacagggtaagaagtggcactactacccttatggatgcgaaggcaagattaaatcagaggggtttaaaacactcgctgaaatcaaggcttggattcgagaccccgatgctgtctggcccggtccaaagcctgagattgactaattagccgacgaatggtacaatggtatgtaggaaattccctactcaatataaggaaactagcaatgactagccgctggaaagaggccgtgtatcgtaagtactcggtgcgtcgtctgcggcaggaactcgaagagttcaaagaagctagacgctttgcaccaaaccaacgcatccgtgcatggtttgatgctcatatcgaatttctagaacgccacttggctattcgagagtccggccaagcctacccagacgacctttggtaattaggtaattaggtgtgttataggtagagattcaaatcatggttagtggcaaggacgccacactttcagcccgcccacaaggcgggcttctttttgcctgaaatttgatgttgacaaggctggccggaatatgtaaacttgcggcatccaacaaaggagggaagaaaatgcaattcaatatatcgaagcaactctgggtagctaaaagcgagcggaagggtgactataaagggacgcttttggcatacatgtctcaagtggacttcaacaaagatggtagcttggctgctagcttcaagaaaaagcagcagactggtatgggctgggcaggtaagaatgccgagacttgcttcgtagacaacatccctgtctcagggcatttcatcggggacagtgttgaacgttgggtgactgagaataaatacttccgtgtgacggacccccggggttttgttctagaagttcctactgggaatatctcgaccttgctctacaactgcacagtaatcaaaggtgtaatccaagagccttgcgtgtgggtacggatgggctcccagcacgttctactgccggaaggctcctctatctacaaagaagcggtaagcttcgtagaacgaaaagagtcggccaaaaccgtcaaagatatggttgcaggtgaccgatgcactcttcttagctgcgggacagagaataaaacagaagctgtctatctcggacaagtgaagctgtcttggcaccttctagctaaaaaaggccggtactctagccgagggtggggtgcgggtcggtggggttaccaccacctagaaagggagctagatagaaaagaattcacagagaaagattcgaaatgggtcagtgtgtttgctaagaagctaggtaatcagtggagcattgattttgtcctatctccaaaggcaactgatattcaatctggaagtgtcccggatgaacttcagaacctcgacctagtagatggtgtacggtggaagtacgatccactcgatgaccgaccctcttcctattactctgtgccagagagggtagttaagtgcatcagcgtggatgatcctctatgggataatctgcaccactacgcagaggtgaggtggacccgggaatggaccgtagtcggtgcggagtggagaaaataaaacctccattattttagaattgcccggctcttgccgggctttttatgcccggggattattttcaaattatttttagatttctgggagtttcggccaatatgggcaatatgaaatttctcaggaaagggctcagaattctcgcatagaggctgtttgagcggaggtatggtaagctactactcggccataaaaggacagtgtagcgtctgataggagggttaaaatgggagaagataagatgggcgcagactcgtactgggagttagctatcaagcaagttgcacatggtatgaatatcgcagaacgtgagcgacagattctcatagctgacctaatcagttggtacgagcgaaggatactgcacagagttaaacgggaggaatatgaggcgatctaatctagggaccgggcagatttttagggactggatagatttttacagccggcaaaattgagaactggacagatttttaggaactggacagtttttcacagaaggggatttttctacagagaaatttcccctcaaatttagccggatttatcagaagggcggatagttagcaggctatctaattgattagcaagctacctttaatcgttagcgcactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgcgcccattctactatgacaaacccctttgtcaacataatttttatggcacagtctttgcaattgcaattagcgtgccagcttaaatctcaggctccctcggtgtttatctccggtgctcggcctcctgcctgcgttgcccgcctgcctgtcattatacacaagcaagaaaagaaggcaagcgaaaatatagagaaaaatctacataaaaccggttgacacgttccttttatataggcacaatgagcacacattcaacggaacggcaggtaaacagccatgctacatagtgaagcccgggcgatggccctacaagagatggacaagtggagcctcctcgaacaaggttggaaattcagtttcaatcgcaggatgaaacggacgctaggccgttgtaatcacgctaaaaagctcatagagctaggttacagctacgtagctgccaatggagtgcctgcggtattggatactatccgccatgaaatagctcacgctaaggcgggaccgggtcatggtcatgattccgtatggaaagagtggtgcggattgattggcgctaaacctgagcagtacgccagcacaaaggaaaaagtagtcacatttcctctgaggttagccatccggcacgaagatggcacgttagagccgctgaatcacttcggtttcagacgcaccaacatggcgagaaaacaggtacgcgggcgtcctgagacgctaggcaggttaatttgggtgaagaacgaaaataagggttgacagcctaggccattcctgtagaatggccctcaagcaaagggaatcaccctgagcacccacgcaggaaagcagatatgaaagctctttgtaatcatcgggcactctacgcggcttacaatcgtagcgagcttgatcgtattgcggtagatttgaaccgctacttccctatcgagaaagatgatgaatgggaagacggcgcatacatgtatcgtcgccgcacctatctggtgaagcattcgaagggtacagcccgttggcacagcctttactgcaatgggaccgtccaaggcgtcggggttatctttgacgtgaagtcggacacacgctctttccgcacagcataaaggagattcagaaaatgcaagcttgggatgtgtatcagaacggccaattgatcgatactgttttcttcgatatcatgtgtgatgccgaagaggtgcggaaatcgctggtcaaccatgacgggtatccgtctgatatcactgtggaggaggccgagtaatggataacttgtccgttaaaatcgttctgtcggaactcagctacaaagccttgattcaagccttcgccttgcttggccgaacgctcgacctagacgaggggttggacgatatacttaatcttattgcggatgagatcgctttccgcgacggcctgccgcctttcgcagacgactgcgataaaacagaatggatgctccgtcgatgggaatcgctcccggtggtatcgtacaatatcgggcaggacggaccgattgtcgctcggtctatcgaagtaaaaacggcatgaggggagaactgatgaccgtcagagtaggagatatcgtggctatccggggcgacattcggaaaaagctcgacggaacgtgccaatacacgcacgaacaattggtaggtggtaagttcctcaagcatgccggcacgggagaaatatggactggccgagtgagtaagatacaaggtgatatggccaaggtgggaggggcttggcgcgggatcgaattctatgtgccggttgacgaaataaatgcttgacaacctgattcactagctgcaaaatagcacccacagacaacgaagacgccgataggcgaggagaaagcagatgcaaatgtttttcaaaacccgtacccaagcccgtgcaatggccaccaatggccgtaaagtggtagacaacggggctcaagctgaaaagcgctgggctgtcaagctgaacaaaaaggaggcgaaataatggctaagtctgtcagtgtagatcgcaagcgttccatcctcgacgaggcgaaagacggtagctttttcagtgtggaattcgtcaaggcagacggcaccgttcgaaagatgacgtgcaagcgccagattaaatcggcgtatgctaacggacagtatgccactcgcaaaccgaccagcgctggcaagccgcacctgtataccgccgccgaggtgctgaacatggaagagggtaaatccgctttccgcactatcaaccttgagactctgacccgcgccaaggtaaacggaatcgaatataaattcgattaaaagcttgacagcctaggccattcctgtagaatggcccttaagcaagacaaacttaaacagaaaggagattaaaatggcacgttctatcaaggcttccgacttcgattccgcttaccagttcgaggccgccaaacgttccgaacgtaaagagtcccgcaaatcgcgtgacaatcgcaaagctagccgaggccgagctttcgacttcagtagcgatatgtaaggtttgtgccctgccggcaggcttaaatgccggcaatcctaagcccattcgtcgagtggttttaggattctcaaccccagcggagataccaaaaatggttcgtcaatgcgtaccctgtcccgatgctcgccatgctttttgccttgcatggttgttcgccatgccggagttcgccggtctgcccgctcaaaaggacataaaactctttaagacttcgggacaatgggcggtatgttatggctagacgacagcggctcccgtcgtgggttcaagaccagaccgaggatgaaacgccgctgagggataggatagacccctaccttagcaagcttggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacaaggttcccgcctcctgtagaatggtcagcaagaaaggcggacaggccgcctagctagataaaggataaccgtcatgcacttcgttcttaacctcgtttccaaaaacagcaaaaccggtcccatgcctgttagcacgtctcataacggcacctgcccggatgcctgccctctcaaggctaaaggctgctatgccgcttatgggcctactgctattcactggaaaaagctaagcaagggtgaacgtggcgtagagtggaaagagttccttaagcaagtgcggtctatctcccgtggggatttgtggcgtcataatcaagctggcgatctcgtgggtcaggatgacgttatcgatgggatcgccctgatggaactggtgaaggctaacaaaggacgtcgcggcttcacctatacgcactacccgatgaacaatttcatgaaccgccagcacgtattgtcggccaatcgtagcggcttcactatcaacctgtcgggcaacaatgtagcgcacgccgatgaactggccgacctgaacatcgcccctgtagtgactattctcccgatggacgcggagaatgtaagctttacgccgaaaggacgtaaagtggtagcttgtccggctgagaaaagcgacaaggtgacttgtaagtcgtgcggcttgtgccaagtggccgaccgggagtatattatcggcttccgtgcccacggcacagcaaagaaaactgtcgatctcattgctaagggttaacacaatggacgaatctgtttacgcaccattcaatcagtgtaagatgatgggcctagaacgaaccgtgcggagcctagcggctccaaacggatgcaaggtagtcttgtatcaggatcacaagaacaagcacagaatcgtcatatacgatgccctagggcagggaatgtccggggtcatggtgcaagcggacggggaaattcattacaaggaaactcgcaaggctagccaagggcagaatctgacaaggcagctacaagctcagctaaccgcatggggagtgaagtggttcccctctcagtatcagacagcggcgggcgcggcctgctacaaaggaggcgagtgatgcggcagcttaacaaatcccagcttaaggccttggggcctaagatcgacctagccttagagctagcttctactggccgtggtggtctaatgaatggccacggctctacctgctacattgcaaacaaagccgggcataacattctgcgggttagctaccataactcccgattcgttgcatatggtgctgagagtgtccgggtgactgggaatgtcattgcagcatgggtggaatggaagggcattaaccgggctgcaatcaacgctctgagtgagtacgggtatcatcctaacctgagcatagggcacaacgatgctcttaagactctgcgtgatatcgagcgttaccagtgacggcctcttactcgacagagaaacggggccagaggtgggccatcatccgtactgagcccggttacagaggtgaccgggtgaccgtgctaggattctgtatcaatcaaacgcacgctcttaaaacggtagccaaattccgggcttggcaagcgctaggctggccctacacactgaaagacgacagaaaataatgcttgacagcctaggccattcgcgtagaatggccctcaagcaagacaaaccgccgataggcaaaaccacaaacccggagactcacttcaccatgaacaagccaatgaacactttcgcatacgcccactatatcgcccgcatggacaaggcctctggtactagcctgccctacgctaccctgttccgcatcgccctgcgtaacgcttaccgcaagccgggcgtccgccagtacgattgtgcagcactcgtcgaggatatcaaagcgcgtgaactggtccaaaagcgcattcgggctgaaaaggctgtagtgatggcggcagtaatgcgtgcaatccgtactggcttcaccgtgagcgtgaaggatggcagcgatggcgagtgggtagtgaaaaagtctaccgatatcaaggaaatttctgacagcctgcaatcgaccgacgaagatatcatccgcttccgcaagggtgacggcccggacaacatcgtcggctctatgtgggcaatctacggtaacagcgctggcgaagtgatcgccgactggactgataatgccaccatggctatgattatggctcccgcagaacgcaagatggaaaaatacgctgaaattgggatttaatgcttgacggggcccgaaaagggccccataatgcacccatagaaagcaaacattgacgggaacggacctatgagccagattaaaatccaagagtatatcgtagccgagatcaaggttaaccattgcgctcacctgcgcaagggccagaccatccaagcccgcgatgctcgtagcagtgaaaagtggattgcattcatggtggaacgcgggtatagtgcctctgaagccgctatcctgttcaaagacgcccatgatgtggcaatgctcgaactggcagcctgaaaaaaaatcctactaggagtactgacaaatgaaacgccaatatactgattcctaccagtgcaaagcaatcgacggcctgatgtctatctgcggtggtaagaaagctatcgtacaagtgtggccgtccttgaaagcctctcgaaaccgccggctgaaaaagatggtaaaatacattgcccggtcaggatggaaaccgtaaccaactgattatcacagccccggcttgccggggctcacaataggagataaaagcatgaataccctgattatccgtttggattccgcctacagcattcaaactgtccgtagtttccttatggaagctgtagagagtattcgaaagcatatccgggactacgcggttcatgacgaatacgattcgggattgagcccggtagcacccaatcatcgacttgcaatcgtcaccttagacgaagattgccgagtgtttcacattcaatgcgagtcacctgatctttatctggcgaaccctcggatcgtgtttactgatgttgaaagcccggcatataccactcccgtgaacgagatcgaagagtatagttacatgaccgcatggcagcatatccgccaaaaagatatgacagcaaaagactacctatcggattgggctatccttttcgcctcaaaggagaatgccattgatatcgacccgcgccccaatctgaaaacgcaaatcttgcattaactgagggagctaggatgaagctgcgaaccatattcgaaacctacgattgccgagttaggtttgtcaccataaccggcgtgtttgtggaatctcaaattgtgcggagtttcggtcaagctcaggagattgtatcactcctctgcaatcccgcagatactggtatccgtctatccttcttcgacgaagaggagggctgcgagtcgatcctctgccgattcaactacaaaggagaaatcatcaaatgaataacaagtataaggataacatcattgcggaatactgccatttcgacggcagacggccagtcctttccttggcggcacgatgggtccaccacgacagtcgcgttgtgaagctggcatcgctctttgcctgtgctggctatggccgtccttacaaggattgtattcgtgcctacaaggacgccaagcagcgggaaaaggatatgcggaaccctgccaaatggaagctgagccgtgccactaagcgggccctacgggcccggcaagctgctaagcagaaactcaaataaactgttgacagcctaggccattcctgtagaatggccatcaagcaaggggatgagccctaagcagtagaagaggtgagaacgatgcaagcgacctaccaagccctgaaaaccctccgcgatgcttgcgaagctgccaaggatgaaaaaggcaccatcaacggaaacaagctgaactcgcttcgcaataaggctgtcaaggaaatgcaagctggtggcgaaacctactctgatgctatcgccatggcccacgacttgattaagaaataccgcaagtaatcaatccgtaacaagccccgggtgaccggggcttctcataggaaagaccatgaaaaacgttcaaatctgttgttcgaagtgtggagccatcaacggcggtaacagcaaacacaattgggttatcgcattaggcaagaagtggtgcggtcattgtgggtccaatctcacaacccttcgtcgctaaccattcactgagacctaatcgaggagagatcatgaacgccactctggcacgcctacagaacgaacgctgtgcaaccctccgcctgatgctcctgccggaacatcgtgggtatcagttctctggccatccttgggccgagcgcatccgcaatctccacgatgaagctaagtgcatccgcagccatcactaaaccgcactaatccattaaagctctaacagcccgccttgtgcgggctttgttctatctgcgaaagcggagctttcaagtgtaattaacatgtaatgttgtaacactctgtagaggtaacaccagcatgacaagatagaccacttgtaacgttaacgttacatgtataacagcatgacagcgaaagctgtacagatagcattctgtccagttcacccctatcaaataaccccacaataacccacctaaaacctatcggttttaagcggcctgtaaggccgtatatgaagcgatagcttcgctatgttagtctgcaccgtcaaggcgagagccttacagtataaggcttgtaggaggttttaaggccatatgcgattagcataggatgttggttgttttaggtagattttgggtataacccctttccgcgctaccattgtctcagtgatgttaacgtttccccgattgtgttaagcgacagcttacatccgctctcattttgcaatgagaattgcgtacagttcatcatgcgcctcagaagtgacttcactttgcatgcggatgcatgctatagtataccctgtgatagctccgctatcccgttttgcatggcacacgaattgcataagcatgacaagggttaccctcgaaagcggagctttcaaagtgctctgtgaagtgtaggctctaccctttagtatattgcgaccggaagtagtgacactgaaaaccttgactccagcccagcaaatacgttaaactaaaaggttgatagctgccgctatcgagtaaccaacattcacacaaggaggcacaatgacaagcaacaatcatgccaagattcacatccattacgctaagcaaatctactacgccatgcgtaaacgtgccatcgcaagcgatgagatatgcaaggaatgggccaagcctaagacgggctttgaagcgttctatgattgggtggtgaatgtgtcagggtacgccgtaggctaccgcctagaccggaatatcctctacccgggaaacaagctctatgctccgcatacatgcgagttcacacctacatacatgcatactctattcaccaactgcgacaagacaagcaataaccgtgccaatacgtgggatagctatatccctctaggcgtccgcctagcacgctatgacaagtacgggatgcctgtatacgttgctcagtgtaggacacttggaaagcagtctacccttgggtcgttcgacgatccgatgcaagcccatgcggcatggcaacatgccaaggtagcagccatccatgaatgtatcgatctctatcagatggaggatgttcacagtgtaaacgttgttcaagcgttgcttgaaagagtggaccaacttggcaaggatattgcacaggggaaagagaccacactgttgcagtagatcgacggggccatggtcaacccctcttagagtgtcctgtcggggtgcgagtaatccgatagcgaagctatcaaatgtatatgcatattccatgccaacatgtggaaagattttacccggcagggcgggagcccgttggcattagttttgcatagcttagctgtcgctaagaaggaaagaccacggccacccattattttgggattacgtgaggttaggtatgcctagtgggttcgtggttaagtagctcggaaataaatccataactggcagaaggcgaaccagcagagggtaggcccgctccctccattattttcccagcagtagaggagacacactctacaaacgtatcactctcttcggcgggggtttaggattcgaatatacctttagcggctaaatgccatcattgcttatttcctattttcgtgctataatccttataggatgtgcttattcttcattatagctggataagcgatggttgtatagattcaccacaaatagaaggaatatagaatggaagataatattcaagctccgcttgcagctagtgcagatggcaaattcgcaactgtatacgaagctattgtcgcactcggagtagaaggggctgccgctgtgtacagggtaggtgtagggaatagattgacaacagctagaccataagcgtggtaaagagaagccccgggcagcgaaagctgatcccggggcttttttattgccttgagtttatgtatgaagagattccagttgtctctgctcttccatatactccctagtggcgtagttcatcatgaggttgcaatactcttcgtttatctggtccatgtattgcaacactttctccatgctctggcatggactaaatccattatgacggagaatcttgcttagattaccctcattccagaagtctctggcccaagcctccaaagctactgcgtagaggcttttgatgcacccgatgggggatggataccaatattgctcagacattagaccctccaaacgcagcaaacaccccttgcttagctaggatagtctttagctcctccagtgaaatggtctcgtctcctacgaccacatacttgtctgccttccctagagtcatcacacacttagtctggaaggtaggcctatacaaggcgtacacatcgggttgccacttgcttcgcaggcctgttccgtagctaatgaaccggtcttcggaatgatcccggatgtataggcaccggggactatcatctggcccatctacggagatagggtgttccatccactccctgatcttatcaacgacgccctctcctaccttcaattgagcgtactgacagtactcaaggaacgcatcaaactgttcggcagtgaaattgctgacatcgatctctttagttttcattctcttcctccatgtctgcaatgatttccttcaacgcttgaagcgtgtaggtgccatttagctctgtagtaggaccagtgtcacactcatgaagcgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatctccaacccacagtagcacttgagccttgtcgtacatgaagccgtttccgctcccaaactcgataccataagccttaaggtgctgttgtactgcaatgttctcttcgggggtcttcacaatagtgtaaaacttcaccaaacgctctttcaatttcattcctcctgtctgtgttttatgggagtgtaaaacgttcccagtccattgtcaagctctctgtggggatagaccgttccagacgctctctagcctcttttagaatgatatcccactcatcgccttcttggactcctacatacttctccatcatcaacgcacggtcaatcagaccagccttgtagttatcccggctacgcttgcgggctaccagcttgtcgatgtagtccttcttatctgccaaagcggcgatagccttcctagccataagggcagcgtattctttttcctccgaagtcatccacggcatattggtcagtacgaggtcagcggcgtccctgaccaaggggatatctctccataggaatcctaccggtctcaggtctgagtctgcggtagctctccactgtagcactgttccggtcttagaatctgtaatatgcaccttctcatcgatacggtgggccatcatcgaaaatctccagttgcggtctacgatccatcgcttccagtcgaagaatgtagcacaaatagccttaaccgggtctccgaccttagcatccagttccttcagacgtttaatctgcttagcgtttatatactttacaggccgggaggctggatcatagcactcctctacctgaaactcctcagcccgagactccaacactttaggctcatcgttactttcttcctctcggaaccatgcgaacagcttcttaaacatattcagtcctcctctcctgtgatagctaccctagtcagtctccacacttttctagggagactaacgaggaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatacgagaatgagaagccctacttgttccatggtgcgatcctcttaagtagtttacggctgttccagatagacagagcccacttaggtaacaacaccactttcaaaacgctgtatgttgcgtagagtagcagaaagctagcatacactgtgtatgtaataggccatagcagtcccagtacaatggcaaaagcctcgataccctctctgtgatctttagtcgcactagctgggaagttatctttgaaatactccgtgatacccatgtaggtccacatgaacacaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtcccacgtctgagacggtgacgctggagtcactgcacagtgccaatctctccagaatgtagcacatgtaaggctcttcttcgttctctaagaatgcccgcatgccctccttgattagcggtgcaatagaattagagttcattgttttcctcctttcgaatcaggtcgaaataagaccagacataaaagttcacccagtttagatcagtatctagcaggtaattacgatgaagaagagagataactgaatcccacgacggaatcccatgctcctctagtagccactctctgaatgaccgatactctccgtgggagatttgcccttcttctgctaggtcgcttagaatataacacatatacgtgtcccggccgtttaccaagtaatcttccagtcccatctttatcaactctgcaactgatctcattgtttcctcctctgagagccccactagggctcgaaatttttggttcgacctccggtcaacacatcacaacccagttgtacaggtcagcctcctcataagctgatgggtagcgattgtactccaataagaacgcgtggtcaatagctgcgtatttggttgcgaagctgccgaagtacgttgtaaatccgttatcgcctcggctaaacaggacgtattcttcagtgccgtccttgaacgtatctagcgagataatatacttgtcgaagatcacagcatttcctcccggctgatgtagtagttgtagtcgtcctcttggacgaggaacgcacggtagaagcctttctcaaagtctcctttcactagcaccagattgccctccaccttgcatgtatagatatacatggtgtttgctactcggataacaggatcatccccgggacgaacatccagagcagagagcatagcctccattggcatgcttgtcaagtgtgcaactacagccgagcagtattctgcatcgcggccagaagtgtcctctgcataagcaggagcgaccccgcacgaatgcagggcgagtgtaaacgcaatagctacgagtttcttgaacatactaaccctcctcttggtctgtctggggaacatccggcttggggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaagacttgcaaaaattgtcaagagcttctttgcagaaagagggatcgacctttcgtcgggtctgtaccaatccagccgggcaactccttggagaacgtcgtccacccacagagggtagtctccatcaagctcgaccatgacttcgtacatttcaggctgaacagcgttgaaaaagaaagagggctttcgccctctgctggtatcaagaggaggaacaagccccctctctaccttgtgaatcaaccggtcagcgttagaccctatacgggcttttagctcttcgatttcttcacatgtcaacatacggaggacacaccttagatttctcgatagtgaatacctcagcgcatgtcaggtttgcaggtccgtaccatttgaacatgttgttgatatcataccgaatcagttgcctgaacttctgaccatcacacatgtctgcgtcgaaccacgcaatagcccatctaacgtgctcttcagggtcgttctcttctcgccatctgcactctagatcaacgtggctaggttctagaacgtaaatgtcttcgaaccctgtgctctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctgtctctgtctgcatggcggtacagattgaagcaaggcacgcctctagaggacgccagttgccaagcggtcctagtcccgccttctggaatcccgttgtggtctgtcttgctccagcacaccaagaacttgct

SEQ ID NO: 3 - DNA, 65855 bp, Pseudomonas bacteriophage F27/12
attgcacaatcctaatagaaaaaatctatcacggacgttacctatctttaaaactaataaaattaatgggaatttggtaatttggaatagtttagtctttgaaagcctcgcggcactaagcctgtacattacccggcaagtttccgattcagctcaaagcgcggcagggtcgccggaaacttccgtctttccaatccatgggcagcggcaacaccacggcggactaagcggcaaggtccaaaaccggacgagcggaaccggaaatttggccacagagcagaatcgctcacctggacatattcctaacattcgatttaacattcaatccaaacactcaccgccaccatcgcccgccaccagccaatccgatcctcacccaccagcataccgcccatataacatcctataacaccacctaacactcattcaccatcaaacccacccatacctaccggccacccacaagcagcccatagacgtgctccctggccccatagtacaatcgcgccatactcagtgtcgcggcaaagcactaggtcccatcaacagccaggcaaccgcgacggtccaagaatcgaactccagggacgcagcaacaaatgaccgccaaatcctacagacccgacgatttagtcacgccacaagaattcgctgatccgcagttcgcggcgatcaaccagaagcgtttcgatctgtacatcgacctgcgcgttcaaggctatagctcctggcgggtcttccgggcgatctggggcgaagagcacatggacgggccggcccaggctcgcatcttcgcgatggagtccaacccgtactatcgcaagcagttcaaagccaagctgaatgcgaccagaacgtccgatctgtggaatccaaagacggcgcttcacgaacttctccagatggttcgcgatcccaccgtcaaggactccagccgtctatcggccatcaaggaattgaacgttctggccgaaatcacgttcgttgacgagtctggcaaaaccagggtcggtcgcggattggcagacttctacgcatcggaagccgaggctcagaccgccaccgtcgctgctgcggctgaagccaatggctatgtacagaacggcgaagagggcgatttcccgtccccgacgccggaaccgaccgaggaagaccgcgccaaccccatttagacataaaataacatcgttctaggcctgaatcggaccgatctaaggcgacggtagcgggtagggacgaaaaacgattctagggctgttctaggaagccgaccaataacgatcagaagcgacaaagccccggactctagttcagaatccggggctttcttttgggcttcttattctccagcttcgatgatttcgaagttgtatttgacgccttcgtgctcgaaagtcaatttgccggccgctttcagctgcatgcggaagcggatgtgcttcgaagagggcaggccgaactcgatgaatgctgcgttggtggaccggaactcaccgcgcttccctttgacggtaacggccacgccatgacgctgggtgcgctttttggagacttccgggtctttccaggagttggcgatggctgcggacaggtctttggcctctttggccttctctggcgcgttcttcgcctcttcgcgcatcttccggatttcttccagcgcttcctcttcggtaatctcttcctccggcttcagattttcttcttcggccttctcttcttccttcttcttggaagtgcgggttttgtaaaccttggccggggcttcctcttcctggaacgcttcttcctcggccggcagagcgttcagaatggcgaggcagcgacgctcggcggtcttgcgatcagagaagcgcttgacagtcgcatcggcgttgtgagcgttgtagaaggcgaccagttctttcatttctgcgttctggatgtcgccgaaggttttgatggagttggtcattttgcgatcctctgttttggaagatttcgttcgggcttcagtttgtcgccccgttgaaagagattatgcctaggtcgatgctgcgtgtctacatttatttcagcataatgacgacgaacccgacgaacggttgtcggatgtgaaaacaccgcaggacaggctgcggtgttttctggacgatgctgcgacggtcagaaggtcgggatcggctcgacaggcaggtcgccaggcttatcgttgtccgacgcgggagacggactggacgggatggccccggaccgaagccccagcggttcaggccgcctgcttacctgcggtgccggaggcgcgggcggagcttttggtgctttcggcactggaggcgcgggcggagctggtggagacatcggcccttctgggaggtcgggaaggctcggttctttcggctcgtagtgaactgtcgtgtcgttgcccggttctgcgggatcgacgcctacgaacggggttgtgacgcagcgcatgtttggatagttcggcagattcttcagggcgatggagtctgcccagacatacggattcttgtgtttgccagggccgtggctgatgatctcggcaggcgtgtggccgttgaggttcagccactccgctatcccttgccgagacagcgggcttaccacgatctggccagtggcctcttcggcaacggcgaacaaatcgccgagtttgaatccgatgatcaagtagttggacctggcctcgccgacgaaggcgacagtttcagtgccgtgatggatatcttgatcttcccagatgtatagcatggtgcgccctcagtaaggttgcttggtgtgctcgaccagagacattccggcaggaactttgaagcgtatgtactcgatcatcatcgcagttcggcgacgattcgttccggactcgtcattcacgaagagttcgcactggtgcggaatgactcgcgtcaccaatgcttcgcctttcgagccgtagaacttgatgtaggctgcgacgcctcgcgtcatgttcagctggatcgtttcgcagagtcgctgcgcggccgacgcgctggacaaatcggtcgggctgaccgtcacccagtaatgagcatttgctgtttgttctttttcagacatcaatggcctccatggtgaagcctccaccgaatggcagaggctagtcgttagtcgcgcttcatcaggacgactttggttgacgagacgtatttcccgatccaatcttcccagtagtcgccgaccgggcaggccaactccagagttacttcgccatgccagagttcgaccgacaggatgatggccctgttccttgctgcgctgtcgggcctgagcttgatcagaatctcgtcgcccgttttgagttcgtccactcttactacttttgccatgtcgttctcctattcgattgagttcaagctgatgattggatagtccctggcgaatttaattccgaaatccttccactcattgccgatgagtgccgagacttcggcgcttactttgttgtgcggagcaggactggtgcgcaggactatggctcgacgccgaatggggtcattgacgtccacatgggtgagtatttcgtcgcctactgtcagttcacaagccaacataaccttggccatggtaacctcctgtgggggaaggcgcggccaggacgatcccgaccgcgccgatggattaacgtttgtgaaggatggacacagagtccacgtcgatgattttgatggtacggcgacggcgcttgttgctgcgttcgtgaatacgaatcagatcggcggatggagcttcgtccaccacccatacgtcttccggtttctgcgtccggagcaggaccgtcacttcagtattctgggcgaggccgttgcagatgaacgtgaacttggacgagggagttctgtacattttgagattcctttttggactttgggtccggcttctcagccggtgaagagattatgccctgattctcaccgccgagtaaagcatttatgtatcaattctcccgtcaggtggaaccaaagcgcggtatcgcttatggctacgctaccgcgccatggaccttcttgctcgcacactgcgaaccacaagctgatttccatccttgccaggactcggccgaaagattcaaacctgcgccgactggctagtatgtcgacattcactcgtcgattgatctcgtaccggcgaccgttgatgacgaagaccagacgcagggtttgtccgtcaagacactcccagtatctggtctcatatcggagccaatggcgtctgcctgtcggcccaaccatagtcatccttctatactcctggctgctccacggggaccggatggtggagtcgggtcgaatcgacccagaatgtagtcgggccgacgcgcttcctgcggacagacggcgagaaggcgccatcctgcgtccagggcatgctggagttcgtccgtgcagcagtcttccttgagaagcaggcgattgacgttctggaggttcggaccaggaatagccgaaccggtgagtgaattccaaccctcaattccgctcaccatctccggttggttgatgtagcttacggacataccggccaaccggcttgcggccagctccagacgctccagcatgggtcgcagagcggctccgggtcaatgtcgtcccagagcagaaccagattggtgatggagtacggatagttactatccaaatcccaggccgaagccgtcaggcgacctaagccgatttcgctacacaccaccgggacgttattgctccaagtggacggctcccagttccgctcgccgggagttccaatggttacgcctttcaggttccccaggagaacgtggaacttgctgatgtattccgcctccagcgccttccgctcttcgtcggtctggttgtggcgatagaaggtcggaggactgatcgtggcctggtagagtttcatggatgttcctttgtgtatgtgtttgacttcaaaaaattttgtcgcagaacttctcgaaaggactctgccttttcttctcgcacaccgcgcaggtcacttccagggcaggaatctcgttataagtcttgccgaagtacagccagcgcttacacaggcttcgaccgtccgccatgaagaagtgaacctttcgagcagcgccgggttgtgcccagccgcgcggcatcttactggacttgttcattatgatcctcttgtttaggttctggaagccatttgttcatttcagacacccatgctccatcgatgtatgccagatagaacatggcatcccgaccgaagctaaatccaacatagaatgagcctgggtctatttccattccggcatgcccgtgatcttcgatgtagaaatcgaacattgcatagctcataccatcaccatgtcgatttcgttgatgaagaagtgcacgtcgacaccatctgcgcggccggtgtaacgcagacgagtcgcgccgtcgattttgacttcttctacgccaatgacttccaagatggtgtcattgcagtacagcttgacgaacatctttatgccggagcctaccgccgcgaaggcgatctgcttatacaggtcttgcttgatcatgctttgcgctcccgtttgctggtgtatatagcttcgacttcggcctcaagcttcgcccaaagttcgttgtccaccggaccccatggtccggtctgggtgccgtcaaccggcgcgaacttcccaccggcgcgacgatatttggaaagggtctggagttcgatgattcgccgttcgtaggcgtcgaattgaggtgtcatttcgcaatcctcttttggacgttcgcgtttcgatgaggtgactatatctaagtcgcctcatcgagtaaagcacttctgcgaaattatttgatattctgtaaggtcaggaggccggacgatttggtcagtcgattgagccgagtctccacccgttgcgggcgaaggccgagcgacccgacagcttgcggcactgaatggagcttccatcgtcgaaagtataggctgtggcccagtccaggcgctcacgacgtactgccgcattggcgatgtcttccagacgggctttaaggagttgctcggctttagtcatctcacacctctttggtttattcactcgatgaggtgactatacctcagccacctcatcgagtaaagcacttttgagagaattatctgaaatttctggaagccaggaattgtcgccagagccagtcaatgtgatcgttcagatagcgctcgccatcggatgacagagacaggcagccgtcattgatgccgagtttggaactggcgatccgttcgaattcgaactggagcgttccgggccgagggatatggtacatgcaatatttctgcacgatcagcagtcctcgaaaggtttacggttcgcaatttccgcgatcctttgcatgccgatgcgatagaattcggcatcttcgcgcgcccgcgacaatgcttcgcgcgcttcgcaagccaacttgtactggttgttggcattggcgatgcttccgtccaggcttctgtcagactcttcccggagcgccttttgggactccagctcggcctccagctcgcggattcgaagggcgagctggctattcgtttcggcagctttgttttccagatcgatggccgatttcgctgctgtttcgagcctgtctttgtcggccatgagggtttccaggctcttgtcgagtgcttccagaagagtcttcttggactccagctccagcgaaaattccacgttctgcgcggataagttctgcgagtgctttagcagttcgtcaattcttctttggcggcccttgatggccgagttcttcgtttcgacttcggcctccagatcgcggattctgagttgaagctggcgattcacctcggccatcttgtcttcgcgagcgatggaattttgcaggcattcgtccagtcgcgagttttcgcgatcaagctccatggccgtcaggctttcgtcagaagtcacaccttcggattcgtctttgcgtccctgatcggcccgcagataatactgcccagcggcgaacgccagaaatgctctggtagtcacctcggtggcgttttgcaagtaagaagacttgtatcgagggacgaactcggcattctcttcgtcccagcagaggctgtctgcgagcggccagaacttccgaaactgggaggtgctgacgcttacgtcgacgaggacgatttttgtcccgtcaacgacttccagttcgaatttgacgtcaccgtcgatgctgttgaaagggattggcttggacacgacaattctcctgtaaatggcgcgaccaaccggccgcgcctgatgattactcttcgccttcgtccgcgctcagccactcttcgaaggcgaaattgaccttagactcgacccaatcttgaagctcatcggcgaactcgtcactgtcgatgtccatcggaatgccaagagtttcttcattccacatttcggcattcagttcgaactggatggccggttcgccgtccacattcagcaggacgcgatccgcgacttcataatcgtccaattcgaagaggaaaccgccgctgatgatgtgctggatgaaagcttcgtcgaagttgctgacgtcgatattgatctgcttagtcatttccggttcccttatttggcgagtttgtactgagctttgagggcggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgtttcgatgaagagattatgacgttattcagaatgtaagtaaagcagaattgtgaaatatttcgcaaagtggacgaacggtatggcccgtcaggagtatttcctcccatggaaggcgtgtccgcatccgaagactgataggtatccgttgacttcggattgcctcttttcggagttgatttcgattcttagcatttccagctcataccgggccaggccgccccactccctttcgatgcgttcatactcggcttctaatcggcgcagacgttcactcatgggaatctcctttggatagctatcactagcatcagtgcgtacaagtcattcgttcgtttcgatgaagagattatgcagttggtcagaatggaagtaaagtgtctagttgagaaaattcatgtacgccgacgaacggttgcgctcgactgtctgctgcggtgtcgatatactcggcctattgcgaataatggactaattaaaatgtataaactcaatcctgcactgcgagcggtctggcgaactcgcgcccgttacaaagtcatctatggcggccgggcgtcttcgaagtcgcacgacgctggcggtatagccgtttacctcgcggccaattatagactcaagttcctctgtgctcgccagttccagaaccgcatcagtgaatcggtctacacgttgatcaaggacaagattgagaattctgagtacaacggcgagttcattttcacgaagaactcgatcaagcacaagaggactggatcagaattcctattctatgggatcgcccgtaacctgtcggaaatcaagtctaccgagggcatcgacattctctggcttgaggaagctcactacctgacccaggaacagtgggaagtcatcgagccgaccattcggaaagagaactcagaaatctggatcatcttcaacccgaacgaagtgacagactttgtgtatcagaacttcgtggtgaagccaccaaaagacgccttcgtcaagatgatcaactggaacgaaaatccgtttctcagtgagacgatgctcaaggtcattcacgaagcttatgagcgcgacaaggaccaggccgaacacatctatggaggcattccgaagacgggcggcgacaaatccgtcatcaacctcaagttcatcctcgcggccattgatgcccacaaaaaactcggctgggagccggccgggtcgaagcgcatcggcttcgacgttgcggatgacggcgaggatgcgaacgccacgactctcatgcacggcaacgtcatcatggaagtggacgaatgggatggtctggaagatgagctgcttaagtcgtccagtcgcgtttacaatctggcgaagatgaaaggcgcctctgtcacttatgactccatcggcgtcggcgctcacgtcgggtcgaagttcgccgaattgaatgactccagcccagacttcaaactgacctatgatccattcaacgcaggcggctctgtagataagcctgatgatatttacatgaagctgccgcacacgacgatcaagaacaaagatcactttagcaacatcaaggcgcaaaagtgggaagaagtcgcgaccagattccggaagacttatgaggcggttgtgcatggaaaggtttatccattcgacgaattgatttcgatcaactctgaaactattcacccggacaaactaaatcagctatgtatcgaactttcctcgccgcgcaaagacttggatatgaacggccggttcaaagtcgagtccaagaaggatatgcgcgagaagcgcaagatcaagtcgccgaacatcgccgactcggtgatcatgtcggccattctgccgatccggaagcccaaaggcttcttcgacttctaaacacagaaaagcccggatcgctccgggcttcggggtcttactcggtgcggttcctggcgctgagtgtcgatgcagcggcctcgccgacttccagagctgcctgaccggccgctagcgcttcggcttccgactcgacgatgaagtcatcaccttggccgtcgccgggcggaacctcgaccagcacggcttcttcgccctcgaaacgcaggtcataggtcttctcaacggacaggccgtaacgggcattgagcgcatcccagagctgagcttcataggtccgaaggtcttgcagagatttctggtggctgagcatcgccatgtcgacggcccgttgcagggtttcgtccaggacgttgagtcgcatgcgaagagaacgaatccgctcgaccacttccgcatccactgcatgtctttcgatcatcgcttttcacctttgctgaatgttacgttgtagccgttgtcggccaaataggtaagagcaccttcaaaggaagttccgacgaggtgccttagctgcatttcgcgctgcgcagcgatccaaaatgcagttccggagaactctgcgcggccttccgacagaacctttccgtcaggcccgtcgattcgaacgtgaacggaagatagcttcagagccattagtgaatccctccactggcttgcgacggcattctttctgcgcgagcagatgcgcagtccgggcacgggcagacctggcggacgcgttccaactcgtcggcgtccatgacatagagcttcccatcggaagtgtcgtgcgccatggcgatgttcgggaagtcggtggcgctcaggccggcgacagcgcggatttcgccccagagcgcttcattctcggcattcaggcgcgcggcgagcgcttcgtgctctttcgctacacgcgccatgaactcgtccatccggaatgcgaattccgcatcgatggcgcgggccgaggccatagagctgaggtgaatcggttctttcttcatggtgattctcttttggctggggtttgtggtctacccaggcctattcaaagcctgggtagcatggtgctgaaaatgaacaagaatgctacaaacgccaatagcgtccctgcgagcattctttcttgactctgcagctcagcatactccttggtggacattccttgctgcgccgcctcggccgcgaatcgggctttcgcctcgataacttccgggcgcagcgaaaggacatattctaaggcctcttcccgcgccttttcgacctcgaccaacctagggtcgcgggccgagacttcgctgtgccctggcctcgcgggatgggcctgcagcgcttgaggaagttcggctgccacgactccatagtcggagcaggcccaagcgatcccgatgaggatcgcgaggatggactggacgattcgcagcatcactttgtcgctaggaagactcatggttaatcctccaccgaccgaacgatttccatattgcgcccggcattggttccggcagcgtaggcgcgccgaccgtcactgtcttccagacgcatgagtttggtaacattcgacttcttgtaacccggatcgccgaaatgttcgtggaccgcagcctctttcaccacaaccagagacgttccggccgaggaaaccagttccatacgtttcctggtgatggattggaggcgatagctgatttcctgggtcgcggcgagcttaaattgcgcagcaaccttgacgttaaaccgctcgaacccttgagccttctgatattcccggcacagacggtctactgcctcgaccagggagttgaacatgttcaccgcaagctcaacgtccgacttgtagcctttaaatcgaacggcatgaccccagcgcttggtggtgcttccgtcgcgagcgctcctggacgccttagccgatgctcggtgattgttgatgccaccggcgaaatccatgatgcaatcattatacgtcgccactgccaccgagaagaacttcatccagttcgggattgcggaatagtagcgagtcgcaatttgctcgtcgaattcttcgcgaatctcaccggttgcttcgaagtcgtgaaggtcatatttatccttcagcttcttcacgcgttctgccgcgatggcagcttcgtgcggactggaagagtcggccgccattgcagtcagcttgcgaatgcgatctttcgccttctcgatggcttcaggagtgaattcgttctggtcggtcatggtcggttccttttgtctgaaggtttcgcgtttcgatggagctattctgccttcatccagagtggaagtaaagcattttctttcattatttcggaagagcctggaaatagttccagatccaatcgcctgcggccaggacaacgacgagaactgcgaataacacgactgcagagaccaattgtgcgccaggcttcagcttggggtggctgagttttggctctaccggattcgccggagcgctggcgcttggcccggcgtcttctggaccaaagccggcgccgcgctcgcgtgcctggatagatgctatggatttcaaatactcggtctgcttttgcgactcttcgtagatgccggcgacggcgaaccagagtgcgaacactacggccgtgcagatgacccaggctccggtcagaaggatggccagcggaccgatgattaagacggaagccgccaggacgatggcgccgccccagatgatgaagccggccagaccattggtgatgtcgatgcagaatttcttcatttttttggttccttcggtcaagggatggatgggatttggaactcggcgccgccgaggacatcaatgacgacctcccagagcgtcggaaccgaccactgataacggtcgaagtcggtttcaggatcgactcccagggttacataggaagtggccggccatttgtgaacggcgccttttcgcatgagagtggccacgcgaccgtcaccgagcggattcgtcctgtgaggaacataagccgacatcgagtattgctgtccagcgccaatgataaattcttgcctctggcgcagacatacagagcctacaggctcccaaccgcgaccgccgcaggcctggcgagccgaagagtgctcatacccttcatgagtcaattcgccgaggcgcgccgaacggtccacgtaataatttgtattctccatagacccaaccagaaccaaggactcgaaatcgaatcggtgatcgtggatggaagagtgatggaaacaaagccggcgcggcagctccggatgccacacatggaggcgtccggccgggagctggacttggatgaagcccaggccgtgcagcgtgattttgtccttcatcgggtcagggacggtatccatggataatcctcagtagcagaagtggatggtaaaggtcatgatggccaagccggtcgcccataggagggcgaaccaggccatggctttgattgtaaggtggatcatccgaagaactttccggcgcagatggggccgatgcccatttcgatggatgcgtgattggtcaactcgcgaccgcagcaggagcattgacccgtcttccgaccgtaggcgactgccgattccattggcttttcgaacatcttcaggatatcgccatactctgtgtcggtgcagtcgcggctcttgatgaacttgccgccagtgatccggccgaggtagatgtcgcccaggacatacagactcccggcgttccggctgttagcgctagcctctttcaccacgacgatgagcggttcctcaccttcgccagccagacgcattttcgggcgcttaatgccagagtctttcgccttctcaaacgctttctcgattcctgaaatgtccagagtcggcgcagcagcctcctgcgcggccactttctcgcgatgtttggcgaggttttcgatggctcgtttcgcagcagcgatctgattctcggtcaacgaaccatatctgtaaagagaatccttaaggctctgggcaaagctgaaagagttgtcagtccaccactcgatgatgtccgggtgagcggcttcgaaagcctgaattttaaggccgcgatattgctcagccttctgtattttctcgatgcgcttttctgccgccttagcacgactcttggcgcgttgctccgggctgctcttgtactctttatatccaacgccgccgcaggcaaagcaggcgcgaccataagacgaaggaccacggtacaggccggtgcctgcgcatttggggcacttttcgcgatacagcttcggttccttccaggagttcgggcgggcacccatggacgcctcttccagggtcttcggcgcttcgttgttgacctctacggtggcgaagtcatcgcccaggtcttcgaagccggtgaacagattctctgctgcgttcatatcgattctcctgtttggaaagttcgtttcgatgggttgactatactccataaatggaaacgcggtagcactttcgcactaccgttcgtcgggtggctgacgatcaataaatgtcgctgctgatcttgaacccatgctcagcgccgtcgttgtagtcatactcagcatagctgtcgcagtagtcattcagatgttggatgattccaagaacgtcgttagcgaccttgtgacgcttcgtcgcgatggtcttggcaatgctgtcgccgacttccagggtttcggcggtccggcgatggatcaacaaacggctccaaagatagagtcggacccggcgaatcatgtcacgatggcgcctcagtcggctctgcagctcttcaatttcgaattcgcgagactttattactcgtcgaagctgctgaacttccaattccaaatcggccttagtagccatattcacctcagaaaggaaaatcgtctgaggctccaggaagctcgacgattgttgttgagcctgagcggtcgagtatgcatccgaccgatcctgccctatggggataatgcctgcacgaactgtaacaagtaacttctttgacgattctccatgtcgatcctccacaccacctacatgctggtgggcgcttcgacttcagttttcgttcgtccaggacggcgcgtctgtcgcaggaaaggcagcgagccttaaccgacgtaaccatgggtgtagtcgatcatgcgaatgagttcgtcatccaccgattccctcgacttcaaaccgttcaatgaatcagactgcccatcgcatttagcgtcgatatccatggaagacagaaagcctgccgacactaatgtgatgtcaactttgtctccagatttcttgaagccttcgcattcagcgtcgagggccaccaacgcactcgcggccatgttgacgtgactgattaagtcggggaagattacgggaacttcacgagacattccacgaaccgtcatcttcagcactacatacttcatactcgctatcctttttgtatgtgaggaaagaatttgctgttttccggatggtggaaacgttcggccgcaggcggtctttcttccggacactgaatcgtcgaaggcgggaaaaccgcgctggagattatcgccgctagcagcgcagcggatgtcgacatccacagggcagtttccaggctgacccgcacttccggtcggcgcggcttcattcgctccaaccccttcccggctcgtaagacgggatgctgccgccgcgaatccaattgtcccacatatggttcagaccagtgggcggctggggcggcggactgtaaaagccgggaacttctgtgctgctgaggaaataaggcgtgcaaacggcccgaacaaccagctgatgtcgctcccacatcttatcaatcgctcttagcatgacgtcttcacactgagctttgctgtcgaaccgtctgctggtatgatccggcatctggacacagccatcgccagtacaaagaaaagcagtggcgatccatactgtgatgcttgccatatcgtcaccctctttggtaggtgagcagattttattccatctgctcgtcagaagtaaagcgcttttcgtcgggataaatgccgatgatgtccgcgtcaagcatccaaatgtccacggacggatcgttgctttcgatctggtacaggtgatacagctctttctcgtcacgcgccgattcgccgcgaggttcgacagccaagatacggccgtgcccttctccatgctcatcgcgatacatgacgcgatccccgactttatagcattcttttttgacgaggcgcgagcgcgagctgttcggcgattccactacccaggaatcaacaaccgcgcctttcacattgctgtaccacttcgcagatttgtcgcagtcgaacacgcccagaacttcgccgtccttcaacacgatatgtacgataggaagaagaggattcatgttaatctccattggttgataattagagtctaatctgccgaaaagttcccgtaaagaattattttctcataactgattagttgcgactgttaatgtgatgtatatgtttgaatctcttttgaacgtttgatgtttcccctataataagcgcacacaaccagcaaccgcatggaattaaaatgtttaaactttcctggatattcgggcgcaaaaaggataatgctgcctgttctgaatcggcgccggagaaagtcgcacgaatccctcagcacgatccgctcgaccctatgattaagcttgggaagattcgcggctggaacgtcgagccggagaaagctccggtcatccgtagcgtgaaggattttctggagccgggtctatccgtcgcaatggacagtgcgtatggtgacgggccgactccagccgcgaaagctgccgctggcggccagaatccctatgtagttccgaccatgctgcaggactggtataactcccaaggattcatcggataccaagcttgcgccatcatttctcaacactggttggtcgacaaagcttgctccatgtcaggcgaagacgccgcgcggaacggatgggaactcaaatcggatggccggaagctgtctgatgaacaaagcgcgctgatcgctcggcgcgacatggagtttcgcgtcaaagacaacctcgtcgaattgaaccgattcaaaaacgtcttcggcgttcgaatcgctctgttcgtcgttgagtctgacgatccggactactatgagaagccattcaacccagacggaatagcgcccggctcgtacaagggaatttcccagatagatccatattgggcaatgcctcagctgaccgcagagtccacggcagacccgtctgcagaacacttctatgagcccgatttttggatcatcagcgggaagaagtatcatcgcagccatctggtggtcgttcgtgggccgcagccgccagatatcctgaagccgacatacattttcggaggcatcccgctcacccagcgcatttacgagcgcgtgtacgctgccgagcgaactgcgaacgaagcgccgttgctggcgatgtcgaagcgaaccagcaccattcacgttgacgtggaaaaggccatcgcgaatgaggatgccttcaacgcccgtctggcgttctggatcgccaatcgagacaaccatggcgtgaaagttattggcattgatgaaaccatggagcagttcgatacgaacctgtccgatttcgacagcgtcatcatgaatcaataccaattggtcgctgctatcgccaaaactccggccacgaaacttctcggcacttctcccaaaggattcaacgcgactggtgagcacgaaacgatttcttatcatgaagagttggagtccattcaggagcacatatttgacccgcttcttgagcgccactatctgctcctggcaaaatcggaatccatcgatgttcagctggaaatcgtctggaaccctgtggattccacaaccagccagcaacaagcagagctgaacaacaagaaagctgccactgatgaaatttacatcaactctggcgtcgtttctccggatgaagttcgcgagcgtctgcgtgatgatcctcgctccggctacaatcgacttaccgacgatcaggccgaaaccgagccgggcatgtctccggaaaacctggcagaactcgaaaaggccggtgcgcagtcggcgaaggcgaagggcgaggccgagcgagccgaagcccaagcgggcgccgtagagggtgcaggcgacccagttccggccgcgccacgcggtactaagcccctcgcgaaagcggccgaggaaggggccggcgaggccgctacaccgccgtcgcggccgaaccccagggccgagcttcggaacctgctgtccgatctactgtcgaaactcgaagccctggacgacgcgcaggctccggacggcgtggacatagagcaggatgacgcgccaggtctgaagcgaacgtcaaagccgagcgtatcgggtatggagccttcggtgttttcgtccaaccgcatcgtcggccctcgtgatcattctgaactccagaggatcaaggttaatggaattactaccttgatcgaaaatccgcgcggaagtatccggcaagggaaggacggtagctggcgagtccagatgaagcaccactatggattcatcaaaggtacgaagggggctgatggggatgaggtagattgcttcgtaggcccgaaccttggttcgaaacgggtcttcgtcgtcaaccaggtgaacaaagatgggcaattcgacgagcacaagtgcatgctcggcttcaacaacattaacgacgccaagtctggatatctgtcttgcttccgtccgggctgggatggactcggctccatccatgaagttgatctgcccgccttccgtcgttggctggcaaatggcgacacgacgaagccatttggaggcaagtgatggcgttcaaagcctccaagaaacgcgaacgccgggcgcctcttccagtcggaagaggcaagcccataattccttctgctggaatcgaagcctggtatcgaaagcaaatgaaggatatggccaggctcatgatcgccgattatcgaagtgaaatagagaaggccatatcccagcctgcggccgaacggtttttcgcgaaagatgaatcggtgaacgtcctgttcaagatgactctgcgaagccttcagcagcggtggaatcgcatctttgaaggtttcgcggccaagatcgccccggagttcgtcaatcgggccgacgaagccgcgaccgctgcgactctacatagcctgtcggtggccggtgtcgatcagccgcgagcttcatacaacgaaagcgtcaggaacaccctggaagccgcgactacttacaaccataccctcatcaccaacattcaagaggaagtccacgagaaaatctacacatctgtgatgttgtctctgacttctccaaacccagaggaacaaggaacttccgggataacaaatgcacttagagaagtcggaaagttttctgaaaaccgaatcgaactcatcgcaagagatcaaaccagtaaactttacagttcgttgagtgatgagagaatggcagagaatggagtcgaagagttcgaatggatgcactcttcggcaggaaagacgcctcgccatacccacctggaaaaggacggaaaaagattcaaactgaatgaccctagactttgggaaggtccaaaggccgaccaaggaccgccaggttgggcgattaactgccggtgcagaaaaatcccaatcatttagtcgtcgataggagtgcgatatgccgttagtccatggaacttccaatgaagcccgttctgaaaacatcaagcgggagattgaagcagggaaagacccgaaacaggcagccgccatagcctattccgtccagcgcagcgagaaagggaaggaggcgaaagattgttcgcctgagctcgtcgccgatcttcgcgccctggtagactcgctgtcgaggctcgtgaaatgaaccgaaagacatgcatacgccgactcgcgaccgatgtaatcaaggccaatattaacggcggattcttcagcctgaagtttgccgcagttgatctggccatcatcggcgtctcaatcctgattgctttcggctgatgatgccgcgaaaaatccggattctgaataaaaattcgggtccggatagccgcaaattaccgtttctgggaaatagcggtaatttggaaagcctactgccgcaaggctttaacatgctaaattcctaatttccaatttcgccgcatgccgcaaaagtatatagcatgggaaattaggaataacgttctaatagaattcatctataagtaacgttataatataacgtgaatcgatatgctctatacgtattgaaattcaatttttaattggtaaattggtaatttggattagtttaaaggttgaaagtcttgcggcagtaggcttagacaaatcccgtcaaatttccgaaaccaagttaccagttttcgcggctgaggaaatccggtaattagatcacaatacagattctagtgtaaattaacagtcgcggctacatctaattattgttccgcttatttacccttggatgtcctgcgtatataatacagccatagtccacgactcttcgaattaacgatggcaaagtcgaaaagaaaaattgacgaaaatggatatatgaccatcgagggttgtccaatcagctcttatggcattttccaatattctgccggtcaactcggtcttccgggcgatccgatgcggattgtcaacgtgtatcgtccggagtctgccgttagcgatcctgagtacatcgaatctctgaagaatctcccgctgatcgacgagcacgaaatgctgtcgggattcgacggcgatgacgacggcgtggctcccgaagacaaaggcgtggaaggcatcatcacagccaacgcctactacgaagctccatgggctcgcggcgatatccgcatctattcccgcaacatgcagcatcagctggaaaggggcaaggaagatctgtccctaggctatagttgccgctacactgagcaacccggcatctggaatggaacgccttatgaagtcgtccaggacaagatgcgcggcaaccacatcgccctggtaaaagagggtcgtgtgccgggggccagagtattggatggtctgtgctttgaccatctcagttttgatttcagaccatccgatgagggtaatgaaatgggtctcaagaaagccaagcagaagactcctgtccagcgcgcaggacaagctgctgattcggcggtcgaagagttgcgcgccctgtggccgaagctctctgcatctgtccagaagttcctgggcgaagaggcgcaggagccggagcaccaggaaggcgcagccgctccggccgaaccgaccgacagcgagcatatgaccgagcatccgactctggaaggcgctcaggaagacgacgaagagcacgaagaagcgccgtccgttgtcgatccggccgtggccgccgtcgatccggaacagcaagaaggtgccgcatccgaaatgtccggtgaaggcgaagtcgccgaactgatctcccaggtcaaggccattctggctcgactggaaggcacggtagccgaagaggcggacgaagaacatggcgaaggtcaagatgtcgtcgagggcttggaagaacagagcatcctctgcggcgcgcaaaccgccagcgacgatggtggtgagggcaaggataacagcgaggaacttcctgaaatggcacagaagaacgcgcaagatgctgcaattcgtggtctctatcgcgacattgctgctaaagatcgcctctacaagcgtcttagttccgtggttggtgcgttcgaccaccgagctatggactcggctgaagtcgctgtttacggcgtgaagaagctggcgatcagctgtgagaagggccaggaagttctggcgctcgacatgtacctgaaaggcgtcgaagctgctcgtggcgcggccagccgtcaatcgaaagcccaggattcggccagttctgctccgcagtgcgccgagctggacagttacctgaagggggagtaacccatgttccagaaacaagtctatcgccagtacactcctggttttcctggtgatctgatcgaggacggcccgaagcgtgcgcggccgggtcggatcatggcgttggcatcggtcactccggccgcgactgccacaggccccaaccgcatcagtcgcgcgttcggttacgcaggtgatgtcggctccctcggtgaaggccagccgaagaccgttgccgcgcgcgcttctgaagtcgtggtcggcggcgcaaccttcttcggcatcctcggccacccgaagcattatgctctgtacgggtcggccggcgattccctggcccccagctatgacctgcccgatggttccgaaggcgagttcttcgacatggccaccggcctggtcgtcgaaatcttcaacggtgcagaagccgctctggatttgagctacggcgatccggtggcatatgtaccgaacaacctgcctaccgccgacaacgccctgggcctgccggccggcgccctggtcggtttcaaggctggctccatgccaactggcctggttcaaatccccaacgcgcgtatcgtcaatgccatcagcctgcctgcccagtcggcggggaatctggtagctggcgttaccatcgtccagctcacgcagtaaggaggcgtcatgagccatatcagtaagacccattcgcgcctcgcaggccgtcacgcaaagccattcgacctgaagaacgtcacccacgaagccgtggctgccctgggtcgcatcggcctggtattcgatcacgccgtcgtccaggaccagatcaaggctttggcgaaggccggcgcattccgttccggctcggccatggacagcaacttcaccgccccggtgaccacgccgtccatcccgacccccatccagttccttcagacctggttgcctgggttcgtgaaggtcatgaccgccgcgcggaaaatcgatgagatcatcggcatcgacaccgttggctcctgggaagaccaggaaatcgttcagggtatcgttgagccggccggcactgcggtggaatacggtgaccacaccaacatcccgctgaccagctggaacgccaacttcgagcgccgcaccatcgttcgtggtgagctgggtctgctcgtgggtactctggaagagggccgcgcttcggccattcgcctgaacagcgcagagaccaagcgtcagcaggcggccatcggtctggaaatcttccgcaacgccatcggtttttacggctggcagagcggcctgggcaaccgcacctatggtttcctgaatgaccccaacctgccgccgttccagaccccgccgagccagggctgggccactgccgattgggcgggtatcatcggggatatccgtgaggccgtccgccagctgcgcatccagagccaagaccagatcgacccgaaggccgagaagatcaccatggccctggccaccagcaaggtggactacctgtcggtgaccacgccttacggcatttcggtttctgactggatcgaacagacctatccgaagatgcggatcgtgtcggctccggagctgtccggcgtccagatgcagggccaaacgccggaagacgccctggtcctcttcgttgaagaagttgacgcgtccgtcgatggcagcaccgatggcggcagcgtgttcagccagctggttcagagcaagttcatcacccttggcgtcgaaaagcgggcgaagtcgtatgtggaggatttctccaacggcactgccggtgctctttgcaaacgcccttgggctgtggtgcgctacctcggcatctaaccgatgctgactcaccaaaggccgggcttccggcctttgttcactctgactctgactcggttgtaggggccggttagggcataattaataggactacgccaatgactgtttacatcgtttccgcaatgactcaatccgtgtcttacaatgcgtatgacacctctgatccgtccaaccctcgtctccagagaaaggtgctgattcgcggccgcgctggcattgcatccgaaacatccggcttcggcgacatgatttccgacgcatccgggcgcccgatctggacgccgcagggcgattgcacggcggtgagcgattccgatttcgaactgctccagaccaacaaaatcttcatgcgacacatggagaaaggttatctgcgagtcgtgaaaaccgacatcaccaatgaccaccagcggattgcgaaagagactcgcaccatggagcgtgatggttttcagcctctggattctgctcgcctgaagcagaagattaaagtgactactgccagcgcttcccaggaacaagagttccgggtttaaccgagggtttcggtatggtgattttcgacgagcaaaagtttcgcacgctttttccggagtttgctgacccagcgtcctatccggctgtgcgcctgcaactgtatttcgacatcgcgtgcgaattcatttctgatcgagattctccataccgaattctcaatggcaaagctttggaagcctgtctgtatcttctgacggcccacctcctttcgctgtcgacgatgcaagttcagggcgcggccggtggcggggtcacagcaggtgggacccaaggcggtttcatcactagcgctacggtcggcgaggtcagcgttgccaagctcgcgccacctgccaagaatggttggcagtggtggctttccgggacgccttacggtcaggaactgtgggcgctcctgagtgtcaaggccgttggcggattctacatcggcggccttccagaacgccgaggattccggaagattggagggacgttctggtgatccctggagcgaatctgctgcgtatggcatttagcgtcataggaacgcagctcgttcagtatcgcaaattcgagcagaggacgaagaatagccaggcgcagtacgtttctgtgtttggcgagccattccaattggccgcttccatccaaagggttcgtcgcgatcagtatgtccagttcaatctggagtttcaacgaaattacgtaatgatcttcgccaactttgagatggttgacttggatcgagatttggccggcgaccagtttatctggaccggaagagtttttcaactagagtctcaaggctcttggttttatcaggacggctggggagtctgcttagccgtggatatcggtacagcaaaactagctgaagacggaaccctgactttctaggtggcttatgttcgacggcgaactgatagaaaaattggtggtcgagcttacttccgccatgacgtcagccaaagaaactttgcaatttcctgattttgaggtcgtgcagaaagcccagccgacccaacagggcacgtcaaccaagcctgcaattttcttccagaagctgtttgacatccctcgcggctggccggcaaccgattggtatctggacaacgccgccagaaaatatgtagaaattactcgacagcatgtcgagacgacttttcagataagttcccttcattggcaaaatcctgagctggatcatgtagtaacggcagccgatatcgccaattatgtgagagcttatttccaggctcggtccaccattcagcgagtcaaggaactggacttcctcatccttcgcgtgtctcatatatccaacgaggcattcgaaaacgacaatcatcaattcgaattccacccaagttttgacatggttgtaacttacaatcagtatattcgtctgcacgaaaacgcagcatattcggccgatggggtgttgataggcatatgagcctgagacgcgattcagaactgatcgccgcgcacttgcagatgttaagagcaatgcgcggcaggtccgtttcggccggatggtactccaccgctcgatatcctgataaggcgggcggatcggtcggaatacaagtcgcgagaatcgcgcgcctcaatgagtacggcggaactatcgaccatccgggcgggaccaggtatattagggacgccattgttcggggtcggtttgttggcgttcggttcgtcagaaacgattttccgggagaaaccgaggtaacaaaacctcacaggattacaatcccggctcgaccgtttatgcgatatgcttggaacttattttccgcagatcgcgccgcaatccagaatcgaatagccatgaggctggccagaggacaaatcacgccggatcaagcgcttgcccagatcggcctggcgttggaaggatacatagccagaagcataaggaccgggccatgggtggctaactcagcatctacggtcaggagaaagggtttcaacagaccgctggtcgatacggctcacatgctccagtcgattagcagcagagtaacataaaccaggagatcatccagtgatcagtcagagccgttatatccggatcatttccggcgtaggcgcaggcgctccggtcgcaggccgaaagctgattctgcgcgtcatgaccaccaacaacgtcattccgcctggaatcgtcatcgagttcgacaatgccaacgcggtgctgtcttacttcggcgcccagtctgaagaataccagcgcgctgcggcctatttcaagttcatcagcaagagcgtcaattccccgtccagcatcagcttcgctcgctgggtaaacaccgccatcgcgccgatggtagttggcgacaacctgccgaaaaacatcgccgatttcgccggcttttccgcaggcgttctgaccatcatggtcggcgcggctgagcaaaacatcactgccatcgatacgtccgccgcgacttccatggacaacgtggcgtcgatcatccagaccgaaatccgcaagaacaccgatccgcagttggcccaagccaccgtcacctggaatccgaacaccaaccagttcaccttggtcggcgctaccatcggcaccggcgttctggccgtggcgaaatcggccgatccgcaggacatgtccaccgcactcggctggtccacctccaacgtcgtgaacgtcgccggtcaggctgccgacctccccgacgcggccgtggccaagagcaccaatgtcagcaacaacttcggctcgttcctgttcgccggggcgaccctcgacaacgatcagatcaaggccgtgtcggcctggaacgcggctcagaacaaccagttcatctatacggttgcgacctctctggcgaatctcggcgctcttttcgacttggtgaagggcaactccggaaccgcgctgaacgttctgtctgcgactgcctccaacgacttcgttgagcagtgtcccagcgaaatcctggccgctaccaactatgacgagccgggcgcttcgcagaactacatgtactatcagttccctggtcgcaacatcaccgtgtccgacgataccgttgcgaacaccgtcgacaagagccggggcaactacatcggcgtcacccaggccaacggccaacagctcgcgttctaccagcgcggcattctgtgcggcggtccgaccgacgcggtggacatgaacgtctacgccaacgaaatctggctgaagtccgccatcgcccaggctcttctggatctgttcctgaacgtgaacgccgttccggccagcatggtcggcgaagcgatgactctggccgtcctccagccggttctggacaaggcgacttccaacggcactttcacctacggcaaggacatcagcgccgtccaacagcagtacatcacccaaatcaccggtgatcgtcgcgcctggcgtcaagtccaaaccttgggttattggatcaacatcaccttctccagctataccaacagcaacaccggcttgaccgagtggaaggccaactacaccctgatctattcgaagggcgacgcaatccgcttcgtcgaaggatcggatgtaatgatctaacggtttgcggcggactcgaccgccgcaaccttcaatgaatggagtgaggaataagcaatgatcaacatttctgcgttcggctcgattgcccaattcacggcaagcagaaccttcccgaacggattcaccgtgaccgagttcgctgatgatgcggaccccatcgacagcccgccgttcactgcggctgataccggcgtcggcctcaatggcgatatggtggtttggaaccgggccaacatcctggaagtcgtcgtcaacgtcatcccgaacaccgagggcgagcgcaacttggccgtcctgctggatgccaaccgcaccggaaaagacaagtcgggtgctcgtgatgtcatcggtctggtcgtggcgatgccggacggtggcaaaatcacctgtaccaacggcactcccatcgacggcgttctgatcaatgcggtggcgagcgttggccgcctgaagacgaagccgtatcgattccgtttcgagaaagtggtcaaagccggtactagctgatgaagaagattccgctgacagcagtcccgaatcaggcgatctcatttaacgccggcagcagctattggaagattcgtctgtaccagaatctggatatgatgaatgccgatatcagccgcgacggcgtgatcgtttgccatggggtccgctgcttcggcggaattccgcttctccagtatagtcatcagtatcgacccgactatggcaatttcgttttcgaccgtgacgccgattggacgttgttcggcgacggcataaacctgttctatctggacggtgtcgagttcgcagaatatcaggcgctggccacgaggaaagaatgagcacatcaacgatcagaaccggggcgaacaatgatatccttttggacgacaatggaaacatggtcattctcagggatgtagaggcgtgcgcccaggatgttcgggcggcgatgctcatgcgcaccggcgaaaacattttcgatgtgaacgccggcgttggatattttgaatatatcttctcgccgcagaagagctatgatgacgctcgcaaatccatcgctgatgcgattttgtcatcgccggacgtgaccggcatcgagcaacttgacatcgacatcaccggtgaagtcttcggcgtcgatgcgaaagtcatcaccatccacgggcctgtaaccgcaggagtttgaaatgagtaccatccgcatccaatacgccaacggcacccaactgttcctggacggcaaaaatccgccgctcctggacccgctgccttctttcaacccgtcggtcgaagacctggaagacctggaccgcgaaaagaacactggcaagggcgactcttcgtcggccggtattcccgttcccccggtaaacgtcgatccgaatgtcgacaacggcggtgccatcccagctccggcatcgaccggtgcccctgcggccggatcggccccggaaagctctcaggaagcccctgcagagggccaaggcgacgagaaagggtccgagacgcccccgactactgccaaggaagaaaagaccgaggaagaggcctctacggccgctaaagaggcctccgctactaccaagcccacggctcgcaaaaccaccagcaagtaaggactcgacatgatcaacgtcagcggcttcggcactggaattgtgatagtttcaacctcgtcgttcccgatggggttttccttgtcgaagttcgctgatgatgagagtccgatatcatccaaagagctggagccgttcgggtatgagatgctttacgatggcggtctgtttgccttcgataaggcggcccctttggaagtgtccatatccgtaatcgcagggagcgaagatgatattaatcttcgcatccttctaaattccaaaaagggatcattccgattccttccaggcgtcatcccagacatgacgactcttgtggctactcttcccgatggcggccgcactgttctgtccaacggaaccatcattaagggtccggccatagataccatccagaacaccggacggcgcaaaggcaacacgtatacttttgttttcggcaactatcttggcgcccagactgcgcgccaggctatttctaacgttattcaatcggttctggaggtgatctgatgttagggattttcaccagcctcctaagctcgcggtctttttcgattgtcgatcagaatacaaaccagctagttgctgcggatttgaggataagccgggttaacacccggttttcttctgtagggcagcgccacatgctggaagacggtacgacaaagatggactccagaacggtccatcctatggagatcatcgttgaggtattctgcccttcaattgatgtcgtcgatcagattaatcaactgctcctggatcgcgatacgctgtacaaagtcatcactcgcggcatggtattcgaacgaatgatgtgtaccagcgaagcgctcaatcagacgccagaaatgatatccgcaactcctgcgcggctgacattttcccaagtgctcgttcagaatccaaaacctatcatgttcaggaatgctggagactcgtccataatcgaccgagggttggccctggccgaagacgttgtgggctcggccagtgatctgttcgactacgcagtgaacggcgtccagaacgccgcagacttgttctgaggtgtcaattgaactctttcctcaaggccattctcaacacgcctactctcactattcgtgatgatgtaaccaaacttcccgtttggaagagtctccaagtcaagaaagtggaaatttattcaccggcttccgtggtgtcgaagcctttggcaacgaaagaccagacggaagctcaggtgtataccgaagcgctggacattgatgtgaagaacgggaagatcattcagccagtgcggcttcgcatcaacgctatttgcccagacctgtccacggttgaaagtatcatgaatgttttcaatgataatacctcgactttcgccatcacttcaaagtcgatattggctgataaaatggccatcatgactctcgatgtagatcaatctccggacatgctaaatgcggctgagatcaacatggagtttgaacaggttgagcctccagtattgaatgaatttgatccggctttctctcaagatcgcccaacttatggcgtgcagattcagtccctttccgatgcaaatttgctagacttgggagccaccggcgattcgatatcttcggccgcaaaatcgctatataatcgcgtgaccagttatttctgaggatgtatcatgcttgaaatcaaccttcccgatggccgccaaactcgcgtacaaatcgaggcgtggtcggcattggatggctgggaactccagcgccgtttcgtcgagttcgcagtcagcaaggatgccgacttccgccgcgctttcaccatggaaatcctgagctatgccaaagtcatcctcggtaacgatgactctgaaattccgttgactactgctgcggtcatcaacaaccacctcggcaactggaagaacgttgaattcgtcttcgattccgtcctcaagcacaacggcatcgatccgacaacgcacgccgaccgcccggactattgggaacaagccggttcgcagatggcaatcgcatttctggccgaggcgtccaagctcattgggccagctatgaaaatcgccgaaggactcgccagcaagccggagtaattcatgtctagtgatttggatgaattcatacttcggtatgaggccgacacggccagagccgaacgaaacctggaacgcctccagaatcagatcaggcgcgtaaacagcgcatcgactagtggccttcaagatctgcgccacttcgcagacggcgctgcaaccgaactcggccgcgtggttccgcaggtggacgccgtaacgagcgcgattcgcgggatgaacgcccagctcgcgataggcgctactggcgtggccctggtcgcggccggcgtcaaggcgttcatgaacaccagggaccagtacaaccagcagcgcatccaggcgatggatatcggtatcgccccggcgcgactggaagagtaccagcggaaactggcccgccagtctggaggaacgatcagccgcgagcagggcgcggaaatgaccaaaaatctggcagatactttccggcgagcttatcgcgatatcggacgggtcggcccagaggcgcggattctgcgcatggccggcgtagatgtcggaagtttccagaaaggcatgaggccgctcaacgacatcatcactgagctggctacgaagatggccaagctgaaaccggacgagatttcggcctatgctgatgccctcggcgtctcgcgagactatctgagcaccctggcgaagatcggcccggcaatgggcaaagtcactgaaatgacgtcagaagagcttcaggctagggtcaggggcgagtcaaacatccagaagttcaacgacgctttggcaaacctcaaccaaacgttcacgactctggaaaaccgtgttggcgaaaagctcgcgcctgcattcaccaagctgatcgaaatcatcgacaaaattgtccaggccattcccaacgaagtggaagaattcgccaaggacacgaaagcccgctgggacgatggaatcaccggaaaggctacggtgggcggcgatattctgtcccttctcagccctggtgctctgctaggtcgcctggcttcctggggtactcggcgcggcatggaagaggccggattaatcgacaagtcgaaggtcccaggctcccaaggtcaaaccagcgaagacctggccaagaaacaggaagaccaggacaaagctacgaagtcgatgaaagagctggagaaattggccgaccagactacgaagtcaacgaatgattttgcggtggcgatcaacatgttcagcggagccgtatcatcgttcgccaatgccgttgatgagcgtcaggcatgggcggcatgggcgggggaaatcgggcgcgcagttggcatgggaagcaccgcgccgacttcgcgagccacaggggtttatccgcacgcgatctacgaccagtcgaagagtggcgcggccggtcaagtattcggcgagcctatcggcgcccagtctctgcgtaatcgcatgttctcgccgcagcgcaaggccgagccgataaatgtcccatcgtacatcaatgatatcatcaaagatgcgtctaagatgtacaacattcctgagctggacatcaagaagctcatatacacagaaagccgattcaatgccagagcgaccagcgaagccggagccaaaggcctcatgcagctgatgccggaaattgccaaggcgtatggaatcaccgatgtgtatgacccacgccaaaacatcctcggtggaacgcgcctattgcgggaaaacctggaccgggccaaaggcgacatgcgattggcgttgacctactaccatggcggcctcgacccgaagaactgggggtcaaggactcgcgcatatcctggtttggtgatgagcgcaccaattgaactgatggaggaagcccagcgcaagcagaaggctgcggccatgacggtcgccaacgagacgttcgcgccagaaggtggcgacatggacattcgcccctatgacggcggaaggctggaagctccggaccagggcaggaaggaggatgatcgccgcgaagctcgtcgatatgacgacagagttgttcggccggagattcgcatcatcgaccgcatgccagaccgcagtgacggcgaaattcttaaaatgtctcagcgccaagacgccgaccgggcggactctggattccggaaattcccgaaccaggtccgtggtgagaccaagcagaacattcagacccaactcaccgccggagccatcgcccaagtcatcggtgttaatcctaaccaaattatgcgccgcgaaatcagccgttctgacttgctgttcggatacaaccaggccatcttgggcaaacagcaggaaatcaaggccgctgcgacagaggctaacaatgtattcctttccccagccaaactcgccgaagctactgccaaggtgaacgccgcatcgcgagaaatggatattctcaggacgtatggtgagaaacttctgaagagcgctccagagcgcggccaggaactgacaatcggtcgaattgatatgttggtcaacgtcaccggcgcgaattctccagaagaggctcgcgaaatcttcagcaggcaaaccgcagaacagctgactactgccatccaggactcccaaaacgattccgcaactaagatactctactgatgaaaaagagaattctgcgagtcacgttcaatatgccctatggacccgaaatcatccgtgaagacctggatgttcgggtccggattatgaaggctgcattgcgaattcaaaaccgagctaccctggaaatctttggactcacgacgcaattgcgcgagtctcttctgtcgcagtttacggcgtggaagcaccggcagcgccaagtcggaatggaagacgagctgatgatcagagtatctgttgaggccggctattccgatcagggccgcgaacaagtttccagagtatttgtcggcgaagtggcaattgtcgatgtcatttcgccgccaccggatattggaattcgcatccaatgctacacaaggcagatcgacaggacgaagactattcgaaatatgccgccagccaacacgacgtttgtaaagttcgtcgaatggggcgcgaatgaaatggggcttaacttcatctgcgacaccagctacaatgatcaagttttgaagaatccgggccggtcgatcactgtcgcgtcggcaatcctggcatcgattcaggatatgtacatgccggatgtggccgcgttcgtcgatgatgacattctggtcgtgaaggaccgggataaggtcattcgtcctgatgaagttgccaacatcaactcattcgtcggcatcccttcatggtcggaatggggcgtggaatttcagtgcctgtttgaaccgtcgattcgcgtggctggcggtgtcgcggtcgaatctctcatgaatccaagcgtcaacggcaactatgtgatcaccgctctagagtatgatttggccagccgggatcggccgttctatatcaaagtcatggggagcccagcagcgtaatggccagggaaatcaaatcattcaatatgttcggcgtgcactacaactcgcggcaattctctgcggtcgatggactcaggatgatgtcgggaatccatgatgttcctccggaagaattgctcaaagggaccgacgtgttggcccatacggaggaacaaccggaaggcgtttggcttcccttgaccgccgcgaacataaatctttatgtaattgaccgggcgaacgtaatagctcccgtacaagtgcttgcgcttttgtctgaactggtcatagattggaactttggcttcctcaaagattggacaggggtcaaaattccagccagatttgtcgaagatatcaaaagtgtgaaaacagcccattcaccttctgtggtcgcaagtttggtggcgaatgggtcagcttctatgcgcgagctggaagaatattattcgactcaagatgcctttaagatgattgacatcatgacggcgaagagcgtgaatgaggctctagcgtccgaagcatcacagaacagaatcaaaaagggataattcctaagcgggcctgggaaggctatactagaccggccaaatcagaggctttcccatgtccaatattcctctaacatccgcaaaatctaccgacagaacgcgactgatcgccgctcttgacgctcggtcgcggcgggatgcgctcgactttgaagtcatgattcccgcccaggttgttcaatatgatcgggccgaaaatatcgctacaatccaacccctcatcacctgggtcgatacggaacacaatgccgtccagcggcatcagctggttgatatcccggtgatttccatgggcgctggcggcttccacataagtttcccgatccagcagggggatatcggctggatttacgcggccgaccgcgacacctcccagttcttggagtcgctatcgatgtcgaagccgaacaccggccgcatccacaaatttgagcatggtatgttcataccggacgtattccgccgatataccatcaattctgaagactcggcagcgatggtcatccaatcgactagtggagcgacccggatttccattcgcggcgacaacatcaagatcactgcgccgtcgaatgtcaccgtggatactccgcaggcgaatttcactggaagcgtgactatcgccaacaccctggttgtaaacggcgtcaacgtgaacaaccacggccacctcgaaaacaacccgcctgatgcccggacgaaaggcggcatgattgcctaaggagaatttcatggctagttttgatttttctgatttaacagcgggggggggttgtaatggctaattatgactacatagtagatactggagtcatagtcgccgatactgctgacgttttgaaagacgttgaagcggaattcagagcggccctcggcgccaatatcaacctggcagcctcaactccccaaggaactctggtcgcggccgagactattgcgcgttccagcgtaatgaggaatgaagctcgcatcgccaacaccatcaacccgaacgtgtctttcgggacgttcctggacgccatctgtgcgctgatggggatcgagcgcggctctgatctttcgacgttcggctatggcgtccaagtgaccggccgcagccagacccgaatttctaccgggtcgcgtgtgcagactccggccggagcgattttcacggtcatgagtgacgttctgattccggcaaccggagtcgccaccatcgacgtaaaatcgcaggactatggaaacatccctcttcccgtaggaaatctgatcatcatcgatggaaccatcggttgggccggggcgaaagtcatcgcttcaactcgcgtcgatcctggcagccgccaaatgaccgatgcagaactgaagaatgctcgcgtcaatcgtctggcgatccaaggtcgcaactcgactttggccattaaagcgtatgtcagcgccgtgcccaacgttacctcggtcaacgtcatcgaaaacaataccggcacggttcaagtcgtcaacggcgtatcattcactcttccgtatgcggtctgggtctgcgtcgccggaaatccggataagcaggccgtcgcagatgctctgtgggccgcccacaacggcggaactccctgggactatggctcggccaacaacggcgtcccggtggatgggcctactggcgttcctgttcgcgatccggcatctggtcgaaagtatgtcgtgaagtggactactccgatcatgtatgacggatatgtaaacgtcaccgttcagcaaggctcttcctcggtcgctccggaagcaatccagaacgcagttgtgaattacgcccaggggaaagtggagggcgaagagggattggtcgtcggcgcgagtctgtctgcctttgaagtggctggggctatcgctcgcgagattcccggcatctacatcaaactatgccaggtggcttgcgtcccggctggatcgccggccccggctcccggcgacttctcgcctgaatacgtcatgagcgcattcggtcaggctaccatttcggttggtaacgttagggtgactttcgtatgactctgcctgcgtacaattctgatattcaacaggcgctgaagtggctccaaaaccaggcccctgggatcaccggcttggttcagcgaaaggctcaatggtatgatcgtttcagccgtcagttttgggtgaactgggagcgcgacgttttcaacttgaagaccgccaacccgttcggccttatggtttggtgcatcatcctcggcacgccttcgaaatggttcggcctgtatccaaaaaacagttcttgggcattcggtcggctacgccagaacttcatctatagcggtacacaagttccgccaccggcagacgcatcgccgggcggcaacttctacggtggcggcaatgccgaaattctcaacttggacgaaatcagaaaagtgcttcagctaagatatgtagcgctgatttcgaacggctcgattgcatatatcaatcgcatgcttcgctacatattcaatgatgatgagccgtgggacgaggcgaccggtctgtacttctatctcatggactcgaccggcgagaatggccctgtggagaacttggccatatatcggaaagattgggaaggtatggtattgttgtccagttcgcccagaacgaaccacgtgctgacatcgacccctgccagcgacgccgattggccgggagtcgatccggccgcgagcggtcttccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggaaaatggctggtggcgttgcgttctcacgaccaagaccgtcagctcttcgttccgcgctgcttacgtagctcctgcagaaaccaacttcagctggattgattcgaattccagcgcggcgattgacgtgcttatctggggcgctcagatcgaactgggtgatactccaactggatacttggagactaccggggcgcccgtgaccatcaccgattatgctttgcagaacgcccagaccggaacagtcaagttcacgcagccccttccgacaggagtagaagcgtattggactggagactggaaaggcgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggttttgccaaccttcgcgatggctacacgccggactacgaaatcagtctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgctccatggtgaatgccaatgcgagcgaccctctcagcagcacgacttgggaagaacaacccgcatggtcggtgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttacgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatcggcgaacgcttacacgttgacgctagttccgcagctccaaggcggcctggtggacggcatgattcttcgtgtcaagttcaacaccatgaacaccggcgcctccaccatcaacgtctccggatttggcgccaaggccatcgtcggcgcagcgaacttcccgttgaccggcggagaactcggtcaaggcctcatcgctgagcttgtattcgacgccaccggcgaccgctggaggattctcgcaggcgcgccacgcatccaagtaggcaacgccgatcaagattatcaggccccaagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctattctcgccaggggtccgctggtcctacccaggatatcctgttcagcaggtcgaatgttacattcctccagccgcgactggatgttgcgaaaaacctcgcgtacatcgcgaactctggccccctttggcagaacaccactgccgatcagcctggttggaaattcaccttcgcacaaggcgtggacgccaacaacaacgcggtgatcgcagtcaataccaccaatcctgacggctcttatcgctcgcaaatcatgcgatgggactgggcgtccacgaacgtcatattcaacaatcgccctctgtttgctggacaatatgtcccttgggactccggaaactttgatccggccaccaagctcactgtcgggactaccaacaacatttcgggaccgaccggaattcgcaataccaccagcaataccggaaatatgaacacctggggctccagctccacaactgcatcgtatggaaacgcaacccttcaaatcttcggtagagggggcggcgagcctgcggccatctacttcgacaactcccaaaccggctggtatttgggcatggacaaggacggccagctgaagcgagcaggctggtcgctcggcaataactcctatgtggtcactgacgagtcgaatattcgtttccacgtgaattctatggctggcactccagtatggggcggaaacgaattctgggggccgtggaacttcaatccgaacaccaagttgaccatcaaagccggcacgcaggaaactagcagcactgcgatattcagcggaaccatgccgttcgccccaatcgcgtctctgtccgactattcccaggcgccattgacggtttacaactcgccgactggtccatctgctaagcctgccgttatcgcgttcattcgccctggaaactggggcgcgttcttcggcatcgataccgacaacaagctgaaatggggcggcggatcgctcggcaacagctccagggaaatcgccgattccagcaacatcatgaatctttgggcggccaacccgaccgcgccgacctggaatggccaaaccatttggcgatccgggaactttgatccggcaacgaaggtggatttgaacgccgcgaacgccaccaacggaaacatgatcttcaaccgcatcgccggaactggcagcgggatcgcctcttccggccgcgtcggcgcaatcagactccagaacggcgcaacggcaggcgcggccgcagcagtaacattcgagcggggcggtgatttcttcgtcaacttcggcttggacaccgacaacgttctcaaagtaggtggcggaaacctgggggcaaacgcctatccggtcatccacgccgggaactacaataactacatcaaccaggcgctggttcaggtaggtcttggcggagtcggttcctatggcattttcgcggttctggacaatgccgctccaaccgcgaccgttcaaccaggagtgattgtggacggctccattctcatctactcgtcttgctccgcaaactacaatagcggtcaaagacctgccggaacttggcgctgcatgggctatgtagtcaaccgggacgccaacacccctgactccgcgacccttttccagcgagtgacgtgaaatgaaatggacgcggatcagaaacccacgttggctggacgcagtaaacatccacgccatggtgactttcgagggaatcggtgaagtgccgttcaccgccaatccgcaagacgttgaggcccacggaagggccatctacgctgcgattctatctggggagcacgggcctatcgccccggtcgattcgaagcgggagaaggccttgcaggacgctatacgagccagggaaaagcgggctatccttcgggatacccgctggcccatagatcgccacgacgagcagagacggctgggtatcgaaaccacggacggccctgggctgatcgcagcccttgttcactggaggcagcagattcgcgactggaacagcggggatcggccgcgacttcccatggctctgaaaacaatgttcaaaaatcaggagtactgatgaaaataacgaaggatattttgatcaccggaaccgggtgtaccatggatcgggcgatcaagtggctggatgacgtccaggcggccatggataagttccacatcgagtcgccgcgagccattgcggcctacctcgccaacatcggcgtcgagtccggtggattggtgagtctggtggagaatctcaactacagcgcccaaggactggccaacacttggccgcgccggtacgcagtggacccgcgcgtccgtccgtatgtgccgaacgctctggcgaaccgcctagcccgcaatccggtcgccatcgccaacaacgtgtacgcggatcgcatgggtaatggctgcgagcaggacggggacggctggaagtatcgcggtcgcggcctgatccagctgaccgggaaatcgaactatgccctgttcgccgaagactccggtatggacgttctggagaagccggagctgctggaaactccggccggcgcgtcgatgtcttcggcatggttcttctggcgcaatcgctgcatccccatggcggaatccaacaacttctccatggtcgtgaagaccatcaacggcgccgcgccgaacgatgcgaaccacggtcaactccggataaaccgctatgtgaagaccgtcgccgcgatcaatcaaggctcctgatcttctccgaaaagaaaaggccgcttattcagcggcctttttgctttccggctttgcctcttcaatcttcctgacttcaataggcgcggcagactcttcctgggtgaccgagtccacatagttccctagcgaactcagaacgccgatcaacagcgctcttaccaccttgtccttgactgtctcgcctatgatctttgtcagaacggatatcaactcttcccggagtcttgggcttattcttggccgaaaacgctttcgatgctctttgcgtttcatgtttagtcctctgtttgcggtcttctcctcaccccgataatagcttggggatgcgctgtgttaatcggaagggtcgggcgttattataactcgacgaaaatgctcgcgcttaactgtttaacgatacgcaccgcgatattaaatcgccttctttctggccaaggaactctggcgcccgagtccggtctaaggcttaatttgtcgacattaaaacgagaaaacccggatcgcctttaggataaggcgtccgggtttatttcgatctagtgtccgctagaatcagtggctcgcgccccatccgtccaaccagcagtcgaagacggcatggcgcggcttatccttcgcaccatgcgggaaatgcgtgaatcggatgacctgacccttgagatactccctgtcattccagcggcgctgtttctcgtcgtgggtcaggctggatgccgaaaccctgaatgtctgcccaggccaaactttttcgttgcggcagacgaacgaaccgaccatgccggacggaacaagattttctgcgtggctggaacgggcagtgtagccaagctcatcgatgaaggcttcgttttcgttgatcatcaactcttcgacgccgataatttcggcctcttcggaatcgtacctcttgaacttcacacaatggccttctttcgcggtcgagcgaccgaacttgtaaattccattcttcttcttaccaatggaaccttcgaagcccaggccgacgtgccgcagctccgcctcggtcatctgttcaacggacgtaaccagctcctgctcgaccaggtggatgcgggtcatttcgaagcgttcccggagttccttgacccgatgctcggccgcgtcgaggcgttcgtcagtcggcattctgggatcggtgaaatcgtcgaacacgtggaacgaccagtccggttcgccatcgcggcggcgaagatcgccggacgatttctgaaagactttcgggtcggttatgtcgccgcagaccaactcgccgtccaggccgttgaaaatcggattgctgaggtattgattgatggccgcgttcgcctgcggcttgaatgatcgggtcagagcgtggccatcgtggatgaaggcgcgaaagccatcgatcttcggcgacatgaagattggcagttggccttccagcagaccgggatcggccatcgatgcgaacatcggtttcatagaattctccagaaagaagcccggcgaaccgggctgaatggcggtaagccggatcagatggtttcgttggcgtgattcagctcggccatgatcgatgcatagcgctcatccgactccttgatgaacacgccgttgtacatcacgcctttgcgatccttgatggtgtcgtaggccgcctggtagcattcgagcatgctggtgtcatgctcttctgccgcgtcgaacagggatgcgactgccatgaccaaactcttgatggcaagccaccgattcccgcgagccagcgagccggccaggtcgccgagcaatttcagatcttcgccgtaggacgggcgacgctcgaccgccaagacgaaggctgacatatggtcgaacagattttcgccgagctgcgcggccatgatggtggccacgaccatgacatcgccgatgccgtctttcacttcggcggtgttattctggatgtaggcttcgcaaacttctgcgaattcttctaccagcttgaggaactgatctttggccgaagagcctttgatcaggttacggtctgaaccccattttaccaccaggtcatggagttcgctattcatgattcgttcgatgatcattctttcgattccttctgtatttgggatttgactgcgttgatgatggacgccgtgctatggcgcgatccgtccttagtggtgccgaagtaaaaggccataacagacttcagttcggcaaaccaatagccgatgatggtgccgatggcgacggaagaagtcgggtccatcagcgcctcgcggccgaatgtgaaaattgcgatgatgatgagaatggaaccggtcagaagagcaaaagttatcgccgggcgaacgaagtcattttgttgcgcagcaagccttctcgccgaatccctgtctgccgcctcggcggcgaactggctgagttcggcttggagctggttttgctcagactgaagacggttttgttcggcctggatggccagctcctggaggcgaacgcgctcggcgctctggagttctgcgaggcgcgctagagcctccggattcgcgtctagagcgctcgcgaccgaggctgggtcggccttcgaccctagcgccgtcgcgacgatagcgccaacggcggcgcctgcaggaccacccaggagcgaccccagggccggagcggccgcgccgatcttactacctatgtccttccagtccatatttcgattcctcaaaagaaaggcgccattacagcgcctttctctggccgttgacgttagaactcttcggcttcagtggcatcgcccacgccaccggcgtcgccgcgcggctgttcctgcttgctgtagtccaccttcacctcaccgccgacgaacgacttgtacagatcggcggccgccttgaagtgatccgggtttttcaccaggccttccagttcgaactggacgccggaccagctgcccttgtcgttcgacatgccgacagtggtcatacggaccaggttggcgaaagtcggcggcgtgcgcaggccctgcggagtctgaactttcttctgggacagagcggtcatgagcttcttcgaggccttgatctgcgaagacgacagggagatcagggcctggccgaagtcgccggtttccggatcgatgacgatgacgtaatgaccacgggtgtcggcgaagtaatccgatttcttgtcactgaccgagccgtcttcgttcggcgcgtacaggcgcccttcgacttccttgaccttggtagggtctttcatcatttccttgaagtcttcgacgctgatggaccctttgaaaccgccctcggcctcgcgaccagcccagcggatgaactcgcgacgatacgcggccgggatgatcagcagaccggtcttgccgtcgtaaatcttgccggtgacggtattcaggaacatgccggccttcgcgccctcgatgtacttcggatcgtcttcatcgacctgcggcgacatcttttgcagcacttggatgaagggaatggcataggaatctgcgtcagccccttcgaaaccggcgccgtcatacgcgtacaggtccatgaagtcgggaacgtcagtagtcgcgacggcgccgccgttggccactgcaacggccttggtttcttcagttgcttcggaagtctcggttttcttgccagccatgttaggctccttgtttgtcgaatttcagttatttctaactgtgggtttataataacgtaagttgcaactaagtaaagcaaattacatattaagctttgctctttttcaccttcggcttcgtgatcttggcctctttatattcgtggacgccgatgaaatctggcaactcttcgcccttctccaggtactcgcgaccgaacgcctggagggtctggtagtgaacatcgcggttgatggtggcgtcatagccggcttcgatgatcgcttcggctgccttcttcgcatcttccatttcgccgcgaccgaattctgccagaactttggtcttgatgatgccgtcgttgtctgtgtcttccagccacttccagaacttcgacttgttctcttccttgacggaaatgatggctttcggctcgacttttaccgtgcggccatcagccaaagtcgtggtcttctggccgagttcctccagaagctcaggaatggtgttgcgcttgagggtcttcagctcttcctctttttcggccagcgccttttgtaaatcgaggatttcgccgtccagctgagacgccttgtccaccaagttcagcagtcgatggccaatgtcggtagcttcgactgccatttcatccatgacgccgaaatagtcaatttcgcccggcgcattgtccttcagatactccggaacttccaattcttgctcgctcatgtcagcctccaacttagtgatgttcccttacttgaactaagtattgagtagatattatgccgcatcttccttgatacggctactgatttacatattaaatttcgtcgcgagtgctaacgtcagcctcgaacactccatcaacgacataactcgcgagattgcgcttccactccaaactagtctggattttctcgtcgatggagtccaggcagatgaggtcgaagtacagaacagagttgacggtcccgatgcgatggttcctgtcttcggactgcatccgcaactcgttgtcttcgtcggtcgtgtagtaaattgccacgtctgcggcggtgagcgtgattccgatcccagctgcggccgggttgcccaggaagacttggacgcgcttggcctgaaaatcatcgatcagcttttctcgttcgtcctctttggtctcgccataataggttccaaacgaaattccttgggtctcaagatacgcagcgatctgaccgatttcatgaatccgcatcgcccagatgatgatagaccgttccgggtcttcctccaacagaccctccagaaggtcggtgaacactgcgaatcgcgggttatcttcgggcggcaggatcaccggttccccataaacgttgatatagccagatgccacttgcttgagtttcgaacgagccgcagcggcgtcgaacgatacatccaacatgaaatcttcgttcttgagcacgaagtggtagtcttcttccactcgctgataaaccttcctttgctcaggcgacatttcgaaatatatgcgcttgtaaaccttttctggcaggaatggtaatgcctctttcttcgtgacccggaagctgtgcggctcgatcagggaccgcagtttgtcgagatttcggaatactggccgccccagatcgtctttctcgacgagctgagggggaacggtcctctttccatccaatttgcgcatgatggctatcattcgtggatcgtcactgggaacaagaacagaaaattcggccacgaacgcccgataggatttcgtcccaagaatgccatcgcgcaaaaattgaaactgcatgaacaaatccgtaggcgctcgcgtcagaggcgtgccagaaagtatgcgacgcgccacggccttctcgcccagttctacaattttctttgcgcgtttcgcctgtgggtttttgatcctcgttgattcgtccacaatcgcgcatactctgaacgtcttgaggaaccgcttgacttcgtcatagccagcctgatggttgatggcatcgacgttgatggcaaatacccgaagcactttttcgtcggagaacgtctcggcatacaggcgatccaaacgcgccctagcctttttggaagtcggtctgccgcgccaatccacgcacagggtctcgactgcgacgtgagtaggaatttcgcgcagaatccagttggtatgtacgcctttgggggcgacgataagcagcgcgtcaacccttccttgcaggaagagcctaactgagtctgccaaagtagtccaggtcttcccggtgccctgctccatcaggtatgcgaaattccttttgttaagggaagcttccagggcattgaactggtgttgcatcgcctcggtcttcatacccttgactggaaaggttttggctttcatttgttctccagatcggcgagaaattgaatgatgttgtccagtccttctgcatgactcgcgacttccaccaggtcgcggctgttaagatcgaacagatcgagcatgggattcaggagcagccaatcggttccgattttcaccagaacgaagccgcgaccgccccagccgatccgctcccgaaggaaagggatttgcccaggctcgaaacagcgcgccattgggcaggtcgaggtgcgctttggccaagcttccagagccttgaactcgacccaaaactggacaccgtgacgattcagacagatcgaatcggacatgccagaccggcgcgtctccaggaaatcgaccaggattctgcctagcgagcgttgcttaaacacattcgcggctttcgtttcgcgatcattcatcgccattcccctcttctgaatctttctctgcttgcgctgccaactttgctttctcgcgttcggtcaatatccgcttgacggccttcacgatgaacatatcgattccgctgagcttccatcctttgatgaggaaccaagagccggtcggcgtcccttcggcaatattcttcccgtaccgaagatatttttcagggcgaatcctgaaacgaatcggttggtcaaccgagtcatccacgcacatcaaatcgaggaactgcgactggcctttgtacatcggattctttccttggtcagccctcttcttctggcggatcggttcattctcatccgacagaactttcttcaccagcttgacgataactaggccatcgtcgccatcgcggatatcccgaatgttctgaatgggatttccggaagtcaccccaaccaactcaggattgtcatatgcatggccccagagcgtatgagattcgttcaaatccgcgaattgaacctcagaattggacaaactcgcggcaactttctcccaatcctgaagcgttttaagatgggagccggccagctctttatattgcgccttcaactccttcagttcagctttcaactcctttagatcagctttgagcagcttctccagttctttgtctctgctgactttcgccgaaagaatctgggcttccagcgcggcaacgtcatcagccttatcctctacatcctgcgccgaaatcgggcaattggccagggcaatcctcgcgaccttgacttcctcgcgaagacgcaagaatcgctcggccttagccgggccgaagcctttggcgttcatgatgccgccgatcaggcgtccgtccgctacaacccagttgagttcggaatgctccgggtccagggccgtatattctacgccttctttggccaattcgcgaaggatagacacagtttgctggtcgtccttcgccgcccgaaggcacgcggccgcgtattccaggcgatgataccgcttcatgtagcaagtccagtacgtcaccacggcatagcttaccgagtgggagcggttgaatccccaggctccgaacgtcaccatttcctgccaaactcggtgagcgtcttccggggcgacgcctatggtcttggcgccttcgatgaacagttctcggcgcttgttgaagaactcttcaccctttcgcgccgacatcgctttccggattgccgacgtttgttcccagtcgaactgaccgatgtccttcacaattgacatgatctgttcttggtacaggaacacgccatacgtaccagacagatactgctcgacctgcggaatggtataggtcacaggctcgcgaccagccacgcgctcgatgtatttagtggccattcccgaagacaacggacccggacgagcgagcgccgtgatgtggtcgatgttttcgaacgcggtgatgttgatcgcattggcgaccgagcggacggcctggccttcgaactggaagatgcctgacatcttgtcttcgttgagaacatccaaaaccgccttgtcgttcaacggtaagtcgtacaactcttgtgcggtcacgcaattcgcatcttggatgacgccaagcgttcgaaggccgagcgcatcaatcttgagaagattcaaatattccgaatcaggcttgtcgagctgcgcgataccttcagaagtcaccgtacagaaatcgattacttcatcgttgcagaccaggattcctgccgcgtggacgccggagtgggatgggtgaatttcgaggtcgcccatgcaggcggacgcaatctcatacttttcgcggaagtcgcggccgggctgagttttttcgaaagtatcctccaatccttttccatatcgttcgtccgccgaagtatattcaatgatcgagtttttgatgttatcggtatcatggaatggaatgccgaagcgcttcccgacgtgagcgataaccgacgcggccttcagcgtattgatgttaccgagcttcaccacgttccaagtgccgtatttctgctggagatattcgaacactagatagcgatgggtatcggcgaagtcgatatctatatcgggaagatcggaacgggaaatgtcgataaagcgctggaagagaaggcgatgcgggagcggatcaacctcggtaatacccagcaggtagcagaccaaagagccggccgaagagccgcgagccgggccgaccagcatgtgcttcttggcgaacgcaaccagatcggctaccaccaggaagtagctgtcgaagtctttcagctgaatttgcttgatttcttcctggaaccgatcttcgtaagcttgggtccattccttgatgtggccgcgactgagacggtaggcttggccctcgcgagccagggcgacgatatcaccatctaggtggatcattggcgcttttgccagttttacatcgaccagctgctcgaccaccgcatgcgtattggccacggcctcgtcgaactcttcgcgggtcatgatatggcgaagacgggtccacaactcttcctcagtcgcgatgtggcgaagtccgaccgattcccgaaccttccaggccgaagcaaaatctacatggccgatggacggcatgtcgttgtaggaggtaatcaccacaggcttgccgaacgccctggccgtctccatggcgccgtgcgcggcgaccatcgacgcaggattgatgtcaatgtagtcgattccggccaagtccaagtgggcataggcctcgccggcaaacttgatgatgccgtcagcatcctggaattctttgggcgacaagccttgattctggacagtcttcgaagtaaggcgatagaattttctggtatctttggctagcgcccaggccttcagcttcagctctttttcgccatcatcggcgcatttgatcgggatttccatgccgaatccgcgaggcaattctgctttggtagctgcctgctcccagcggacgtgaccccaggtcccatcatcgacgatggcaacaaaaggtgattcgatttctttggcgcgctcgatgatttccggaaacctgccatatgcggcgccgtatgagtagccggagcgaacgcggagttgagggaaagacattatgcggcctccattgcttgatacgcccgatatactcccatgcgcttgcatacttcgtggagcagccgcacgtcgtccaatgcccggtgcttctgaacataagggccgcagtagtgctcatacagatgctgcagccgcatgcggtggccgaataacggcgccgactcttccacggtacagatgtcgagcgatgggaagttgacttcttccaggccgagctttccgcgagcaagatcgcaggtaagcatgaatttatcgaatggaaggttgtgggcaatatttgcgtcggccttcgaaaagaaatctcgaactttctggcgttgatcgaggaatgatgggtgtttgattaagtcttcattcttcaggcctgtgattttcgtaatgatttcttcgatcacaatcccagggttgcaaatgaactcgacttcatccaaaatcgtctcgccatcggtgatcactccggcgaattcaatgatcctcggttgctttctcagacttaccctttggtggaacgggagtcctgtggtctcagtatcccatacggcgaatctcatgtctgttccctcttatgtcgaaaggccggctgctttcgcgaccggcctgaagagtataccgcaacggcgcagggttatgccttctgtccgtctttcggcgtgatgcggccggagtgcatggtggcgtggacaaacgctgaatagttgatcaagtcaaataccgaatcgtcatcctcaaacccactattcgccaggcgagtgagtttgcccactgtatgcatcacgaacagggcgagccgatggtcatctgcggtcttcgccaccatgccattcgggaagaggatttccatgatcttgccatacatcagatcatttcgaccataagcgctctggcggtcgcggaaaatttctgcggctgaggacaggttgttgagaacatcctccacgaaatcatcgggatcggcatcaccgtcgccaggccaggcggattccatggcgaacggcgctgctgagtcttcggccgcctcttcggtcggctcttcggccggtgcttcgtagagcggagacggggactgcgcaaacgcctcgtcgagggtaggggcggagtaggagtctgcggcgatcgtctcgcctgccatgtcgctgggagcgctaccggggtcgctatcggttgcgacggcgaagaacggcgcgtcgcaaccttccaggtccaggatgtaggcgtcgatgcccaggcccttgtaggcgtcgatgatgtcctggcggtcatcgaatgccgcgacgatcctggtcaggccgtcgatcttcttcagaatatctagcgcgactgagcgcttgaactccggcgccggctgggtgtttccatactcccgcatgatgagctcatattcgcgatgttcggcgatacccaggtcgcgatggattttcgccctggtctgaaaatagttgttgtcggttcggccggtgatgaagaaaatcatcaggtcggagtcgatggcgttacggattcgtgcgactgcatgcggattgagcttgtccttgtcgagacgggaatggtactcgtcccattgcttttccagggcgaagcttttacggtggctatcgtcgaagacgcatccgtccagatcgaagatcatgatgccattcttgggttttcgtgccatattcagattccctcgctttctgctttctgggtgatggttttctcgatgaaagtgccatcggaagttagacggaacagttcaccgttctgaaccaaatcgaacgatttcacgttcatggtgacgcgaattgattcgctgccgttggtcacttcgacttgtgcgacatcaccaaccttctcgatgatgatcttcatgctacattgacttcccattgatcgctacaggattggcctcttgtttctccgatccccagaactcgcggcgcagctcttcctgctcggccgagcgatccatccatggacgatagaacttgcactgatagatcggtttcaccggcaactcaaccacaggaatctggccgggcttcgtctccagagcggacatgaagcggtcataggattgctcatggatctcatcttcattcagaaccttcgatccatagcgcgggaaggcacaggagccagtggcgacgcagtgcggctggagcagactatcgaacataggatagacttccagaaccagtcggcgcatttcgcggaaggcttcctgatactccccttgcgtacgaacacacaggcgaactttcgccatgtcgctgagagtccgcagattgaacttggccgcgatcttcgtttccatgttggaagggatgatcgcgcgggcatcctggagcgatgcgccggcatccaagagcttctggtaactggtctgcgcgtcggcgatggcatcgtgccacaggcggttcagctcttcgcgggcgtgataggtcgggtccggctcgccattggccgtagcctgctcatcgaaatcccagcggaatgcttccggctgaacaacggcgctaacctccagggcgcgactggtttcctgctggtaagccccggtccgcgtccgaacgagttgatgggtgaaattcttgctcacaccctcgatctggaaaatgaagtccacgaattcgaacggcgagcgaatggtgtccagcatgtacttccagtggtcgagcttttcggcttcggtcatggtcgccgggtcttggccgcgcatgcgagtggatttcgtccccaggagaagttcccaggcgttctgggtgtaacttatcagagaaattttcatcaggaatcttccggaattggcgtgaaagtgaatttctccaccagagccatagccagcgcttgtgcgtcttccttatgaagaccgtatctgtcgatttcttcggccagcaatctgcaagcctccagacggtcttcatactcttcggcgtggcacatggacgaaaagatagtgccgtcagaggtccggtacaccagttcaatggacattactgcgatcctcagtagcagcggatgatttcggcgcgaatatcgcgacggtccaggtaatgctcaataatcttgtcgcgggcgcgctcggcctcttcgcgactgccgaacgacaggttgaacgaagtgaaaggcttatcgtccaggcgcccatcgccgatcaggtacaggatgcctaccagcacgaaagacggcgctgtctgtcgcgtttgcggcgggtcgatttgcatttcgaggaaagacatgggaacctcttcaggatggtctggtgagtacattaatagcgctcctgctgagcggccactgtttccggttcgtagatgagcatgtccacgatttccgggcactggcttttcacccagtcgattgccgccaccatcgtggtgtcggcgccgaaggtgaaagttcgataagactcatggatgtacggcgaacccatgaagtcgcgctcggtcgtgcgagaaatgacaactttgatgttaacaatccggcccatcttcggcctccactttagcgatgatatcggacaggctcagcttctcgccattcaggaaataactggcgcgaaacttcctgtcgccttctggcccgacgatccgggctgttattgtgagactcccgccgccaagggcatccgtgtccctgaagaaagccagcagcgcccgcttgagcgctgcctcgcgaggatcgactgccattaacctaccacattccagccgtgctgggcgcaccaaaccgcgccagttcccgcaggaagactgttaagaaggaatacaggggtcaggcggccatcctcggtcatgtggatgaagtagcgtgcactttcaccgagccattcggccttggcgatggcgcgttcgaggttgatcttggtggcgtaggtcttggtggtgtttttgtcggtggagaaggttacttcgcgggccattttgtcgattccttttggttgaagggtttcgcgtttcgatgagggaatactactctcacctggctcagaagtaaagcactttgtgtaaattatttcacgaacatcttcttggccttctgataagacgaagaagtcatcaggcgctcgatgacgtccatgtccgaaaccagatcgtccagaaggacgtttcgccaggtcgcgaaccgaccgagcgagaagatgccggcttcatgggtgagattccagatcatggattcgcgctcgtcgcgaccgagcggaatgattttacccttggtctggacggtcggctcgccgtccggaatgagattcttcttcctgatgccgaaggccgagcaaacttcatccaggtcccagttgctgtcccattcgatggtttcgatttcaccatctacagtctccacgacgcccttagtaacggattcgacgataagggtgtcgccggtgatggacgctcgaaacgttcccacttcgggaccagggaaatacaccgtctggaagacatcgcaaggaatggaaagcttgtatcgactcacgacgatggaggttccttcgccgaatgactggtcgatccccaggtccagccctgccgcagccagattggcgcggaatggcgccgtgctgatgatattaacgtgatcgtcttgccggcgaaggaactggaagaaagaggcgtcgaaaggcctgccccagctgatgcgattcgccagcttagcgaccagctgctcatagtagtcggccggcgcgatccagcgcttttcggtcgccatgttccagatggaccgatccgacaggccgcccgttactttcctggagtacatgttgcagtagtcgatgcgcggctgagaaacgaactcgccgtcaatgtagatggccttgtgcacggtgacttcgcggaacgggatgccggtgagttggccgatgactggtgagcggaatcgcaggagcgcgttgtggcgttccttgctcgtcggcgtcgctgcgtcgatgatttgggcttgaggaaaacgatgcgcggcgatcaggccggcgagtccggctcccacgatgataactttatgatcagggatcatgatatgttccttatgagtgtacagaacttgagaggataaaaaagggacccattttcatgagtcccttgaagagctagacgattcggtctcagaagagcggcggcttactcttcttcaccatcggaaccgtcggcgccctgaccttcaccgtcgtgctcctggccttcatcggccttctcgtcatcgccctggccagcttcgtcttccttcgaagcgatggcaaccagatcgacccagcccatgatttccagcttgctcagatagctgcgaaccgaggtgccgtacagcaggtgggccaccttctcgccgaaggattcgatttcgaccggctcaccaacggtgcagtgctcgttgatgtaagcaaacaccttgccgcgagtcgagaaggcctgcggggttccatggccgtcgccggtcgggatgaagtgggtggcgcgcggacggcgcgaaccattggacttcaggtcttcgcggcgggcttcggccttcgcgcggcgctcttcctgctcttccttgcgacgcttcttctcggcctcgcgctctgccttcttctcttcggccaggcgcttgcgctcttcttcgcgtgcggctttctgggcttcctgcgcggctttcttctcttcggccttcctggcgcgctcggcttccttctcggccttcttctgctcgcgctcggcttccttcgccttcgccttctcggcctgctcggcttccttggccttcgccttctcagcgcgctcggcttccttggcggcggccttttccttcgccttctcggcgcgctcggcttccttcttctcgcgctcggccttgcgcttctcttcgcgctcggctttcttctgctcggcttccttggccttggcttcggccttctcggcgcgctcgcgctctttacgttgacgctcagcggccttctcggccttgcgcagggcggctgcttgttccttggtcagctcttcgccttgggtctgttcgttctggtctttctgttccatgttcttactccgggaatgttttaaagggatggcttattggcctgtgaggggattatctctaaactaactgaagaagggaatacccttagcctgaactttcctaaatattttctttcgggaaaatccaaactctagggaacttatttatgttcgagaagttcctagcttttacgcaagaacagtaagtattcgattgcgcgagttatcccagtatacatcaactgactataagggatggacggcaagttttcttctaacatggcgacccgtttccattctgaaccctgcgacttgtggaacgtcatcgcccagccgaagtcgaatccgccaatggccttctgcgcctccagccgcacgtcttcttcgaccgaaaaactcagagggttgaacttcacccagcgctcatagttcgtgccgataatgcgaactttggcgaacaacatttcatcaggctcatcatcatcttcttgcccttcaggaactggcttgaagtccagcagaatggcttgttcgccgttcatgattccatattcgtgctggttcccagtgcacaccagcttctcgccgattcccggctgcgcacctttgtagccgaggattcggcgagcgcgtgcgttcaagcgacggcgagtattgttgtaagcgcaaagaatcacaccatcgttgtccaggaacgtccgcatttcatcatccgacatatcgaagccggcccggaccactatgtcatcatactcgcggcatggcaagcgcttgccctggcgaacaaacatcgacgcccgaacgatattgccggcgttgcgctcgatttcggtcatgatggtatcacaactgttctcgtggaaaatctggacgccgcgcacaggaggaacttggccaaagtcgccaatctccagaaccggaattcggtgcgacaacaggcgctcttcatcccactcgccgatcatggacgactcgtcgagaactaccaacttcggtttctcgtcgagcgagtctttgttggcaaacatgatttcgccgtcttcatcttcaccaatcggtcgatagataaagctgtgaagagtccgggcattgacgcaacctttctcacgaagccgagcggcagcctttccggtcggcgcgatgaagactgtccagtccatcgagcagcaaagttcggcgatgatcttcgcaatagaagtcttcccagttccggcaaaaccggcgagtcgatagacctgacggcggtgcgctcgatcacaccaaccgcgataccagttaacgacggaattaatcgcgtcgatctgctggctattaggtcggaagccgaatcgctcttcgatctgatcgacggtgaagttagatgctgacatatttgcgttctccaacgctaggtttaattgaattgagactcagtttaagcagaccgtccacagaccacccagtatcacgacgatatttgcggccgtgcggatcgacatagaagtttttcgtgcgccgcaacaggacatagtgccaagcagcgccgagtgcatgaacccttcctttataagggaaggccttaagttgctctgcggccttcttcgccccagggagccagcggacggtcgaaaggaccaagaccgcacccttgacagcctgggaagcggcgcggccgtcctgtgggctatagcgatgtctatcggggtctacccagtggtggttgccacgccggagcttcaccgtccgggaccggccctcaaacaccacagtaccttcgtgagtaaaaatatgttccgccatggaatgttccttataacgtacagttctgctttacctctgcgcaagaagagtatactatcagctgactcgtcaaagcgagctaatttaatccgactttacttcggcaggaaagtggccgatactagcgccgccgcctgtactgccctccaaaacagaggatacattaaatgcaagaatgcaagatttcccgcgaccaactcccggtcggcaatccgaatcccaatgtcgataagactcgcgacccgaacctaaagcccggctacctgcgtcgcagtcgcgagctggacccggctctggccgttcgcatccgtcgcgagctgatccatgctgaagcctccgacttggccatggctgggtgggtcaactcccagtccagcctctatgggtcgaaggcgttccctcgccattccgtcgttcgcgtgactgggatggcggaatctgaaacgaacatcggaatgctcatcggcttcatcgagcaccgcaagcacggtgaatgggcagttctggaaactgggacgaaagaaggcggcgcgatcaccatcccagtcgagagcatcatgcgtgcgtcattcgcagaggccgaagaattcgccgagaaatggaagcgtaacctggggtggcgcctcctgcgtcagcttcgtgaatgcggcgccctggccgggactgaagacgaattcctgcggcggatcatcaatcgatatgttcgcgatctcacgatactctcccaccacaaagccggtgcagacaaaagctataccgatgcagtgctcaaaagtatcggcgaagcatggccgcagattcctgccggaacattcgtcggccaccgagtcgcgcaactcctgatcaatcacaaactaggccgagctggcaccatcttgaatgacctggtggacctcctggagaggttcgcggccggtcgtgataaagtgctcaatatcgccatttgtaattgaggttagtgatatgccagatttgatgaagctgagtcataggcaagttgaagctctgctagggctgtctaggaattcttacaattggattcacggtccttcgactgattcaaccttgaaggctctgagacgaatgggactcgtaaatttgtcctgggatgattctgtagctggatacatgttcggcagtcagccttgttggagcataactgacgccgggaaaaaacgaatcctggcaatacagggaactctgacagaagagcctgaacagcaatttaatcccagcccatgccgccatgagccaggtaagtccgattctgatcgacttgctaagcaactagaaaccatcgctcgtctggaaaaggaacttgaagaatcggaaaagcgcgggagcgaactggcagcaagctattgcgacggcgtggtcggtgatgaatacggtcacacttactgccgctacagggtggagcgcgacgccgctctggccgaagtcgagcgcctgcgcgaggaaaacgccaatctaatcctcgcgtgcgcatcgctggatagtgagaagcgcgagatgcagcacaagtgggatgcaatcatcgccatgcgcggcgacgccctggccagggtcgcggagcttgagatgaaactggacaaggccgactacgcctatgacaacgaccgcatccacatgcgcggcctggcagcgcgtgccattgcgcgcgccaaggtcttcgatgacggcagtgatggggccgatgccgagagtgcccgcagcgtggtcgccatcctccgcgaattactagccgtcgggggcgcctcggctcagcacagcgcgccggatggttatgccctgatcccggttcgcgagactgaggcgatgcacgatgccgtaatggcgctgctgtacaatggcgtagcccgcactgatacgcagaagttgctggatgcgtacatcaacgctgcgactaacaaggagtccgtgtaatggaaccgaagaaaccttcaccagtagatggagtcatcatgaccagcctcgacgttctcaggaaggcaaagcctgaagctcaggacgagtatgccctgtccatgttcgcaacggcgatccgccagaagttacagcgctcccgcgataagggccgaggtggctggatcgactgcgacgaaaatgttctgctggatggattcgccgagcatgcgctgaagggtaatgagaacaatctcctggacctggcgactttcctgatgttcatgtgggttcgcggcatcgatgacgcgaagattcccccggctctagaaaaggcgcgacagcacaagatcatggaagcctggagtcgaatccatgaagacggcctaaactccgccagaaaggcgagtgctgcgcgacaattcgtggaagtgcctcgacgcaaggggcgcccggagcgacttgcatgaagcctcacgaaataagactggctcaggccgaagaattcctgagagaactcggcagagggattccggacgacgaacgggtgatggtcggctacgctgaagaggccacagtccagaccgacgaaaacggccgcaagctcaacgcaggctggtggcccgtgccctggaaggaaggcaagtacatcaattccaggtcaaacgcctacgcctgtatctcgtcttccatcaagacgcccaacccgaagaccggccagatgcgatactggcgcggcgaggcctctttcggccacggcctggcgttaatggtcgatgacatcggctccggcaaaggttccaaaggcgacttcgaccgcgacgagttccgcgaacgcctggagccgaccgcgattgtggagacttcgccgaacaactaccagttctggtatttcttcaaagagccgatgtcccacatgcttcagtttaaggcattgctctattcgttcgtggaccaggtgctaaagaaaggcggtgacaacaccgtcaaagatgtcagccgttatggtcgcatgccattcggcttcaacaacaagcgcgggaaagacggcaacttcaagtatgccgacgaaaacggcaaacccgaactcgtgcgtctgtatcacgcagactattccaagcgctactcgccagaggaaatcgcccaggccttcggcgtccgtatcattatgccacagatgaagaaggtggagataaatcgcgacgattgggtttatgaccaagtatggctgaagtatgccgagcacatctgcacgaagtacaagatgggcgaggcagcgggcggccaagtccaacagaatatgtccggcaaatatcgcatccgctgcccatggggagatgagcatacaaacggcgatccattcggcgcctactttcgcggaccgatccctggagctgagcacgaatatgtgttcggctgcggccacgatacttgccgcaaagagcatcgtcggacgtgggctgccttcacggatgaagtcgtgctaccctatatcgtcgaacaattggaaagaatcaaccgccgtcacatcggtgaggagtagacaatatgcaaaacgatcctggaatcctgatcacagccattggcttgctgttcctcggccttatcatcttcttcgaaggcctaaagggatggaaaatacaagtcgcaaacttcctcgcgtcgcttctgtgctttttcttcggcctttctgctttgacgttctggttcgtcgttgcgtttgacgtattttaatcgacgaacggtacagaaatttcggatggggacggaacttattagctatgccggtttaggtaggagataatagccgtccctttcgcctcaatatgtagaggcaatgttgaatccgatcatgtaaagcagaaggcggcaaacctaacatgattatcgacgaagataatatttttgatgatggcgaatcagggtccagtgagtttgatctcacacagatagaagatgctggaatggaccctttgatgaccgccgctagcaaggcggccgatgatgcgattgcgagaaacgaaacgcatcgcgcacaaaaggcggcaagatacgccgaggcgtatgcggaaccagacttgagaaagcgagcgcgattgttgatgctcgaccaggcgttcgatcttccggtcagccgggtggtgaaagggccgttcgatgacttcatcactaaatacagctcgacttccgacagcaactatctcgcggtgtacgatactttgttctgcaagggtgatggaaccgtcccgcatccgcacttcgacgagtttcgcggacggctggtggaccatcgcggcgtggcgttcaacaacaagaccctcgacccgattgacctgatgggcgccctcgcggctgcggccttggacgatccctcgattaagaagacgattgagacttgctgcgtttgggcgcgtcgataccgccgcaactcgctgatagagacgttcgagaagaagataccggagtgggacggcgaagagcgaattagcacgttgctgatcgatctttttaagccattcgacaccgaattgaaccggatggtcagcaagtatttctggctgagcctgtactgccgcatcaactatcctggaatctcggcgccgatctcgctggcattgattggtgggcaggatgcggggaaatcctatttcggcctgctgatctgcaaggaactgtcgggcggtcgcgatctggctcccgtccagctcgatctgagccgacacgaccagacgccattcctgcgcaacatcaccggcaactcggtcattgcgaacgtcggggaaatgtccggcttcaaaaagggcgatatggaacgcatcaaggagttcttggtgcggtcttctgatacattcgaccagaagtttgagccgggcgaaacgatcaagcgacaatggatcaccatcatggacggcaacggctacgatggcctccagcgggacgactctggtaaccgacgtttctatcctatgttcgttgcgcaactgcccgatgaggatggaaagccgaactgggttaagccgggcgatggcaatgaaccattcaaggtggacttcaccgacttcggccgcaaattctggcaagcgatggctgagtgccgcgcatggatcgaagagcatggcgtcgatggctacctgaatatggtgtcggaagcaaaccgcgaagtccagaacttctctatttcggaaatggagaatgcgcgtggcgtggttcgcgacgatacgattgatatgtatctgatcaatgtgctgatcagttgtgagtttgaagaggttaagcctggcaagaattccaagactcctgggtggagggcagacacagtttccattctgaagtggttcgatattctcgccaggaagaagccgatttctcgccatttaactccgcacctgaaagcacttgggttcattccgaataagaacggcctgaatggatggctcctgcctgtggataaggtcgctcctggctggtcgaagaatatgcagacgacgctgccaccattcaatgatgcgctggtgtatctgctgagaaagggcgatccggatatgaccgatgaggctgccatggcaaaaattcgagcagtacgggcagagcgagccaagatgttgggcgaggatttctagtgtactgatgcagttgtggttggactaggccgccttcgggcggtctttttcttggtgcggagaacattaatttagctcgtgaacaggtgaggtttgaaagctatgtgggaattagggttgggtgaaggcgttgtattatgggaagttgatagattttcggtattggtctggcgtgtatgatggttggattttgtgtgaaatgttgagaaattatgggtttgaggtggattttttttgggaaatagccgcaaattcctggatagcgattctgactgggaagatgggaggcctactgccgcgtgggttagcggccaaattccctaattcccggtttttcgagcatggtttaaaactattctacagcgaaaatcg

SEQ ID NO: 4 - DNA, 47463 bp, Pseudomonas bacteriophage F83/13
ccagcgccttcgagctgcttcgcgcgagccttggcggcgtcggcgttggcacgcaggttgttcgcgccgtcgatgccgttgccgacgttgcgcagctcgatgcgcgctagccgcagtgcctgactgacggcacgcatcaggcagctgttcgcggtggtgcgcagagcagctacggcagccggggacttggaatcgagcagatcggtgatgtaggtcatggtacggagtcctatataaagtggcggaattgccacaacgacaaaaaggggcgcacctcccggtgcgccctcgtcgtcagacctgcgatggattttcgatgcgatgcaccgcggctagcagctcgtcgttgatgcgagccatgtgccgcgatgcgctcggcatgtggtggtcggccatttcaagcgcagtgccgaatgcctcggacagctgcgccatcagctggcggttggcctggagcagagccaggaactcgttgacctgcgactggctcattgtgcagccgccttgcgagcgcgaggtttgcgtgcaggcttggccggctgtgcgagctgatcctgaatgctgcgcatcgcagccagcaactcgccaggatgttcgttcagcatgttgcggaactcgttgatgatctggcgctcgccacgcttgtgcgcgaccttggcactgaccgactcgtaggccgagctggttgcagatgcggtcgcgcgtgcgccagcagcgatgtcagagacgatggccgaacccaggtttttcagagcagcgaaagtggtcatggtagatcctcgaagtgaatgaatgcgtagagacagagagcgcgctgctccgcagcgcgcacggtaagtcagttgaagatggcgtcgatgaagaagcgctgcgtgtagtagacgaccacggttgcgccagcgaggatgggtacgcaccaccagccgtaggtgaaccacaaggcatataagccaaaggcactgatgccgacgtaggtgatgcagaagatgatcaagccgaggctgagcttgagagcgagcacacggttgagaaccgaaacgaaggtcttgtagcgagcgagcaaggtcatgatgcgaactccagtgtggatgaaagacacaaggagtaagggtgattcgctccgcgaatcacgagaggcatagggggagggggtaaggaattcttttggttcggagacgaaaacgaaatccgaagtggggagtgggtgtgtttgtaaggggaggggtgggacctcgcccccacgcttctacgggtatctaaaaccaaatcgcatggccatctaaaaccaaatcgcacgaccatactaaaaaccaaatcgcatggccaccggagcagtttacaaaataaaaccaccaacccataaggttgtcacgttgaacgtttcagtgctacattcatcgcgttcaacccaaccgcaaaggatcacggcatgaacccttccctgaagcaagtcaccatcgcagcctgcgttacccacctcaacgacctcgactacctcaagtcccgtatcgaatacctccagcagtgcatcgactccgaagaccaattccaggccgacgacgccatgcgcgaactggccactctgcacatggatctggtcaactcgtacggcggcatcatccaacgcgctcgtgaagccttcggcctgccctccatcgaagagctggctcgtgaagtggaagaaggcaagcacggttcctacagcaacaaggacgtgatcgaatccaagcgcgccgagatcgaacgtgctgaacacgagctgatgcacgccgagccgtccgcactgtcgagtgctatcaccggcgcgaataccgaactcaacaagccccaggagtgatcgaatgtccatcgaatccgagagcaagaccgaacaggaaatgaaggccaagggtttgaccgccccgcgcatcccctcgtcgtacatccagagcctattcgaccgtgtggtcgtccgctgccacgtcgtagaaggcaccaccacgaccgttgccgtcgcgctgctcgacggtgagttcaccctggctactgccatcagcgcctgcgtggacccgaacaacttcaatcgtgagatcggtgagcgcatcgctaccggcaaagccctggatcaggcccgcgacaagctgtgggaactggccggcttccgtgcctggatggatgtgcgcctggaacccaacggcctcaccagccccgtacaggagtgactaccatgtttgcacctactcacgccgacctcaacaccgcgcaggctgcgcaatctacggcctcttcgcccgtggccgatgccatcgtcgaaatcgagcgtaccgtcaaccgcctcgatcgtgcagtggacgagctggcagctcggctcgcaccagtcagggtgactaccgttgcagcgagtaacgacgtgccggtgtctcctgctgtacatagtcctttgttcaatgcactcgactctctgaacgaccgcctgcgctatgtagagctggcgcttatcaaaatcaacgagtcgctcgaaatctgacctgcgccgacctctttacgcgcccctcggtagctgcgtagactgaacctgcgagccatgccgaccggtccacggatggaccacctactccctgccccgctacactttgtgccatgaaacagccgtcccatccccgtggagtacgacatggcacgcaccaccaaagccgctaccaaggtcaccaagaccgctaccaagacaaccgctaccaagacaaccgctaccaaggccacttcccggcggccgccctcgaaaaccaaggcggccaccgccatgtcacgcgcatcgaccgcagtggctgaggtcaagtcggagcattcgtttgtcgaccctgacgagcagcgccactacaagctccagcgcacccgcgcgaagtccctgatggacctcgacccgatggaaagggagttctgcatccgtgtggcccaggggcagagtcctgtcgatgccgccgccggcgcgaacttcccctccccgcggcggatgccaagaagctgatgaaccgtgtcggcgtacagcgcgcgctgcgtacgctgttacgaaaagaacatggagatcagcgaggtcacgcgcgaagagatcatccacgggttccgggacgccattgccatcgcccggcagatggctcgacccccgcacgatgatcgccggctaccgggaactgggtctgatgcacggaatgtacgaagccaaggtcaagatcgagatcaccggcggcgcagcgcagatcgcagcgcagatgcagaccaagaccgacgccgagttgctgaaggtgatccaagagaacagccggatcttgtcggccgaggaaatcgaaggagccgaagatgccgaatacgtcgagtgagcgtaagccgcgctggcactgctcgaagtgcgaatcgccgatctactacccccaggcacagcaccgggatctgcctgtcctgccgcgtcgccggccgggggaacaagatcgtcgatgtagcgaatgatcctgtcgataccgtgccgataccgaagtcggccaaactgaagaaggaccggatcgacaagaagaagccccgcgccaacccgaagatcatgcgcgagaacacgcggtcgaattcggcccacgtgatctacgaggacggcagtatcggggtcgtcagccgggatagccacgagtaccagctggccgccgcgcagaagatcatggccgagcgcacgctcatgcgccggcggttcctcccgttcgtacagaagatgaactcgaagtacgaggtggccgtcgcacacgagattctggcgcgtgtgctggagcaatttctcgacgactccatgaacgggcgctcgccccgcgtcatggttacgttcccgccgcgacacgggaagtctgaacagacaagccggaagttcccggcctgggcgctagggaaatacccggaggcggggatcatcctggccagctacggcatggacttggccgagaagatgtcccgcgacatcctcagtacggtgaagagccaggaatacaaggcgatcttcccggacttggaactggtcaacgaacgtatcgatgactgggccacatcgaaaggcggtggtgtacgcgccgcgggcgtcggcgtcggcgtgaccggtatgggctgtcacatgctgatcatcgacgacccgttcaaggaccgggagtcggcggattcggagacgatccgggagaagacctgggactggtacacctcgacggcgctgactcgtctgacccccggcggtggtgtactgctgatcaacacgcgctggcacgatgatgacctgtccggccggctctgcgccgcgatggaggaagaccctgagtacgagaagtggaagatcgtcaacttcgccgccctggccgagaacgatgaatggctgacccaggatgatacgatcgtcgactcaccgctgcccggtgccgtaccgttcaggaaggccggggaagctctgcacgaagcccggtacagtcggaagtacctgctcaacctcaagcggatcttgcacgcgcgggactggaacagcctgtaccagcagaacccggtgccggatgacggggaatacttcaagtcggactacttcatcgagcacgaccctggggacgagcgctacgacggcacggcgtacatcgccgtggacttcgcgatcaccgagaagcagaccagtgactacaccgtcatcgccgccgggctgcacatgccgaacgacacgatccacgtcgacgacatcatccgcatgcgcacgggggacgagctcgaaggtggtcacggccatactcgacaccgtgcagcggtacaagtcgcataacccggtcctgggcgtggaagatgggcagatttggaagtcgatcaggccgtacttcgaggctgaggccaagcggcggaaaatctacgtcaaggtagagcttctgaagccgctgaccgataaatcggcgcgtgcccggccgctccagggccgtatggcgaatcacatggtcacgctgcgccgcggcgctcgctggatcgagacgatgaaggctgagttccttcgattcccggtgggccggcacgatgatatagtcgacgcgcttgcatggatggcacagctgatccttactaagaacccaccgctccctctttccgcgcgccggccgcgtcgcggggatcgcaccgttgcgcagcagttgtccgacatcctgcgcggcgtcggggacggcagtcacatgagcgcatgatggggaacgcccgatgatcaactccgcatacacctttgacctgccgctaccgggcacgttgtcgaagaacgacgagtccttactggtcaacgcgacgtggtgccgatacgactacatgcgcgacagcggccacgacaagttcattctcaccgccgagaagtgccaaaacttctggtggggtgaccagtggaaagaggacgatatcacccgcctgcgagcgcagcgccgcccggccctgacgatcaacttggtgctccagaccatggacgtgatggtcggggagcagattggcggacggaatgagatccgcttcagcccgcggtacgggaacgttgacgatcgaaccgccaccgccctgaacaagacattcaagcacatcagccaggggaaccacctgacgtggaagcgcacggacgtgttcgaggacgggaacatcaccgggcgcgggttctacgacgtgcgcctggacttcacggagaacctgtacggggaggtggccgtcacgaccctgaacccgaaagaggtgctgatcgatcccgacgcgactgattacgaccctgccacctgggaagacgtgatcgtctcccgctggatgtccccgaacagcctcgaagccctgtacgggaaaaagaagacccaggagctgcgcgcgctggccaaccagtaccgttctgcgcagaccaatgacatcccggaccagtaccgggaccggattgcgttaccggagtacatcaacaagaccgaagagggcacccagcgccaggatgcctacatccgcgtggttgaccggcagtaccgcgtgctgacccgccgggagctgttcgtcgatacgcgcaccggggagttgcgccctgtgccggacagctgggacgagttgaagaccgctgagtacctgatgcggaacccgtccatcgtgcagatttcgcagatcgccaagcggattcgctggaccgtggtggccggctctaccttgctgcacgacgggtggagtccctacgagtacctgacggttgttccgtacttcccgcatttccgcttcgggcacaccaccggtatcgtcgagcagctgtttggcgtgcaggagttgctgaacaaaaccgccagccaggagctgcacatcctcaacaccacggcgaacagcggttggaaggtgaagcacggctcactcaagaacatgaccgtcgacgaccttcaggcgcgtggcgctgagacaggtctggtggtcgaagtcgaggacgtgaacgacatcgacaagatccagccgaaccagctcccggccggtctggaaggcatgaaccagaaggcccaggcatggatcaaggcgatctccggcgtgaccgactacatgcgcggtgaggcacgggaggacgtgtcggcccgcgccttggaaaccaaccgcatggccgggcgcgctggcatggcccgtatcctcgacaacctcgaccgcagtgacgtgttcctggcccgcgcgatcctgagtatcgtgcagacctactactacgaagagcggctgctgtacatcaatggcggcggtgtgaacaaagacgagtcgttcaccatcaacgaggtgactccggaaggtgagatcgccaacgacctgaccctgggtgaatatctcgtcaccgtccagtccgtgcctgcgcgggaaaccctggaggacagccagttcgatcaggcgctggcgatgcgcaaggaagggatcaacatccccgacactgtgcttatccagaacagccgcttgctggacaaagccgacatcatcgagcagatgcagagcgaggcgaactcgcccgaagcgcaacagctgcgccagctgcaactggccactgcccaggcaaatctggcgaaagtcaccgccgaggcacagcgtgctcagtccgatgccgcgaacaagtctgctcaggccaacgtcaagaacgtccaggccgagacggatgcgctcaaggccggcaccgataccgagcagcagcgtgccaacatcgagcagcagcgcgtggatatcgaagccgcgcggttggcgcttggacagaccaaggtagagaatgacctcaagatcaaaactgccgagctggcactcgaccgggagaaactgcgactggacgcggttacggaacggcttaaaatgaggatcgaagcagagaaggccgcccaagagccgaaacctacccccgcgaagaatggagaatccactgatgcgtaatttccttcgacatgtactgtccgctccgatcgatgaaggtgctgccgccttcggtaccgaggctgatatcgacatcgattccatccctgccggcgacgccactccgggggcgcacaacgagggtggggaccgcggcgacgctgctctgttcgatgacagccccgcgccgaaagcggacgctccggcacgcgacgaacaaggtcgctttgcacggaagaccgtagaagaagagttcccggaagatcgcggcgacaatcccgcggacccgaactcggccgaggctaaagccaaagacaagcccgaagacaagcccgaagacaagcccgaagacaagcccgaagacaagcccgaagacaagcccgaaggcaagtccggaacggagcaggaaccggagccggagcagaagctcgacgataagggtcgtccgatcccgaacatggttccgcgctcccgcatgcagaaggaggctgagcgccgccgggctgctgagcacctactggagcagcagaaccgctcccgcgcactgacctctgaactggtcgatctccaggccagctacgacaagctagagtcgcgcgagatcgaagcgatgaaggccaatgacttcgatctgctgccgcagatccgcaaggacatgcgcgcgattcaggaagccatggctaccaagcgtgccgagagcatcgctgacgagcgcgcccgcgaacagctggagaacctgaagttcgaagagctgctgaccaacctgcggtctactcacgccgttctggacgacaacaacgccgaggcgttcgaccagggcaccgtcgacgagatcaacgagctgttccagtccctgtcgccgaagtacggcaaggtcatcgccatgacccgcgccgtcgagtatgttctgggcgtggaacaagctgctgcggtgaaaccgctgggccagcaaacgccgcaggatcgcgcgcgccaggagcgtcggaaagaagccgtgtcgcgcgcgaccgctgccgtggcgaaccagccgaagtcgccggccgttgcaccgcctgccgcggcttccgcgctcgtgcgtactccgcagacgctgaaagatatcgagtcgatgtccgaagctgagcaggcaaaagcacgcggcgacttcgattacgcggagtgatgttccacgtggaacacaaagcccggttattgcaaccgggcttttttgttgcctatagtttgcgcattcgccaggtccgcgcagcgaccacgcaacacctccccgcaagtccgccggtaagcgcgcagcttacacctcagaactgaatcactttccactatgccgcagaagaggatgcagccatgccgttgcccgtccaaggtaactacaccaactttgcgcgcctgaccaacgaacagaagaccgtatggtctcttcagttctggcggcaagcgcgtaacgccgcgttcatcaacatgttcctcggcaccgatgccaactcgatgatccagcagatcaccgaactgcgtcgtgacgagaaaggcgcacgtgccgtaatcaccctgatcgctgacatggttggcgacggtgtggtcggcgacaaccaactggaaggtaacgaagaggcgctgaccgccttcgataccgttatccagctggaccagatgcgcgccgccaacgtccacgaaggccgcatggccgaccagcgttccatcgtcaacttccgtaccaccagccgcgacatgctggcgtactggctggccgaccgtatggaccaactggcgttcctgtcgctggccggcgtgagctatgcctatcgcaccaacggtgcgctgcgtggtagctcgccgttcccgaacctcaccttcgccgccgacgttactccgccttcggccaaccgtcgtctgcgctgggatggcaccaacaaggtgctggttccgaacgccgccacctcggatgtcaccgccgctgataccccgagctacgctctgctggtcaacctcaaggcgtatgcgaaaaccaagtacatccgtggtctgcgcggcgacggcggcgaggaaatgtaccacgtgttcctcgacccgctggccatggccaagttgaagctggacccggactacatcgccaacctgcgtagcggttacacccgcggcaacgtgaacccgctgttcaaaggcggtatcgtgaccgtggacggtctggtgatccacgagttccgccacgtgtacaacacccgcggcatggctccgggtgccaagtggggtgcttccggtaacgttgacggctgctcgatgctcttctgcggcgcacaggcgctgggcttcgccgatatcggcaacccgcgctgggtcgagaaggaattcgactacgacaacaagcacggtatctccgtggcgaagatcctcggcttcctgaagcctcagttcccgtcgatctacgaggacggtaacaccgaggacttcggtgtcatcaacgtgtacgtggccgcctaagcggccacgttccccagtcctctggaggataggaaaatggcaactctggaaaacaccgcacgccagtacccgctgttcatcgagcagaccctcgatttcagcgatctggtcgacggtcaggccgctaccctgaccctcgaactgcaaaacggcgcgatccttgtcccggagatcagcaagctgctggtcactaccgcatcgaacgcgtccggtgccgctaccctggatatcggcgtcatcgaaccgggtgtggcagctgacccggacggcattgccgccggtctggacctgaaaaccactggcgcgaaagttctggctccggccaagctgacctacccgaccggtgcagtgatcaccttcaccgctaccgcttccactggcggcaccgctggtaagttcaagttcctgctggcctacatcgtcgaaggtcgtggcaacgagacttacggctccccggcgtacaactgatacacttcgacggggcttggggagtcgaaagactcccctgttttcactcccccaacgaacagcgtaggagcacatcactatggctggaccaaaacccccgtccagaacaccgtccaatacgtctccctgaccgatcaggtcgtggctaccatcaccgggcacgcgtttcggttcgaggccggcgtaccgcgttccatcccgaaccacaacctcgtgctgaaggctgtacgtgaagccggctgcgtcgacgtgaacagcatcaccgacgagaagctgcgcgcttccctgaagctcaccggcgagccgggcaccgctaccaccgtcgaccagcagatcgacaacgacgcaactgaacgcgtcgaccagatcctggccgccatcaagactctggtggatcgcggcgactctgccgacttcgcctccggcggtaagccgaagaccgaagcaatcgcctccatcaccggcttcgaagtgaaagccgctgagcgcgactctgcctggaagctgtaccagaccgacaagccggagtaaggccatgggcacccgtgtagctgatcttgtcacgacgttccgggaagaaatgcgggataaggtccagccttacttctggtcgaacgatctgctggtcagctacatccgggaagctcagcttaagatcgccgagaaaaccctctgtctggtcggccagttcacccttgaggtggagcctgggaccggcatcgtcatcatggacgaggcgatcatccgccctcgtcgcgcctggatcgactcccagcgcggcgaggttgagatcaattgcgtcgaagaccagctcccggcgttcggcgtgcaagacgcctggaactgccacggtagtaaccgaacgctgacggtgcagttcgaccagcaaggcgatgtcgaactggcgctctaccgccccaagcccaacaccgcgctccagctcactatcgctgcgtaccgtcgcccggtatgcggcctgacgattaacgacaagctggagatcaactctcggtacgaccgtgccgtgctgttctacatgaagtacctcggcttgctcgtgcaggacgccgaggtgttcgataagtcggaatcgaatgagcagcttcggctgttcggtatggaactcggcgacatcaaagagtcgcaggccataagccaccgctcgttccagccgattcgctacaacgagtattaggggtagacatggaaagattctggtcggacttcagcgattggctatatgccatggctcttggtgggttcggcggcgcggctagccatgtgttcctgaaccgaggcaagaagttcgttgtctctttgttcctggggaacgtgttcatcgccatgttcgccgcgaaggcgctcggcggattcgtacctcccagcgagtaccgggacagcttgctgatgctgctcggtttctttgcctacccgatcttgacggcgctcgaagccaccgtcgtagagcgggtactggcattcttcaaacgggttttcccgtaggaggctccgatgctccccatcaccatcatttcgtcgcttatttgggccatcacgttcgcccgtgtagtcgagtttttccgactccctgagaagtgccgagaagatgataagaccctcgtggccggtatcggtgccatgagccttctggcgatcctggccatggtcgtgatttggtccgagcagcctgcccggttggtgcagtccgggtacggcctttcgatcctgatcggcttcaacatgctggtagcgatgttcatgtggtccttggtgaacaccttcatcggcaacaaggtgagggtatgcaaccaaccccattcctgatcctgctcagccttctggttgctgccggcctcggcggcgcagccgggtggacgatccggcggggaccgttgcgaagccgagaaagccgatatgatggctcaggcccgcgaagctgctgaccagcagcgggcagcagctgtgcaaaaagcacgcgaagacgctaaaatcacggcggccagcaccgaccgtgtggatgttcaacaaaaagacaccgaggtgcggactcaaaccgtcgttaaagaggtcgtccgctatgtccaaaatcccgctgctggtaagtgcgtccttcctcctgattgggtgcgcgtctacaacgcctcccttggattcgacgcagcagtgcgccccgttcccgaaacccgaccagcgcctgatggtagtgccggccgagttcgagctgatggtggcggcagatgacaaggaagctctccaaacggcgaccagcaacaacctaatcgccaaggattcccgcgaccgtcttgtggaactccagaaatggctgaaggaggtcttagatggtcatcagtaagcagcagttcgaggcgttgttccccgacgctcccgacgaagtattcgaacccctggtacgcagcatggtccgctacgacatcacgtcaccggcacgtgctgcggcgtatctcgctcaaattggccatgaatcctccggccttacccgcttcgaagaaaatctcaactacagcgctgcccgtttaaccgctgtgtggccaagtcgctacaaagcacacagcggcggccccaacgccctagctacgcaaatcgcgcgcaatccgcaggccattgccaacaacacgtacgccaaccgcatgggcaacggcgatgtgctcagtggtgatggctggcggtatcgtggtcgcggcccgttgcaggtcaccggcaaggatggctaccgcagggcacaggtcatgaccggacgcccgttcgtagatgacccggacatgatggccacctatgacggcggcctcgaagccgctgccgctacgtggcgagataagggctgcaataccctggcggaccagggtcggtttagcgagatcacccgccggatcaatggcggaatgaacggagctgaggacagggaaaaccgttggcagaaggccaagaaggtactggcgcaatgagcatcgagacgcgcgacaactgggccagcgggtccaacaacattgccaagccggagcggctgccggagaactccgtcgtcaaggcggtgaacatggacccaaccaacggcgggaaattcgagctgcgcaccggcttcgtcaaggtgaatgactgcgctgctggccgagcggtgttcccgctcggcacggctatcctgttcgtcgacggtggcgacctcaaagtattcgatgtcaggaccaaccaggggcatgtcgtcgggtcggttaaccccaacggtgatgtggccggctgcgaacacaataaccagctgtacctgtcctacccccaccgaaagccttcgtttcgacggcaacacggttcggaagtggggagtaccgtctccggtgtacaccatcgatctggttgacgggcacttgccggcaggcacgtataaggtagcggtgactgcctatggcgagcagggtgaagagtccggtgctgacgccgttgccgtgtccgtacccgaaggtaaagcgatccagatttcgtgcaacgacccgcggtcctgcacggtgtattgcagctctgtgaacggatcgacgttgtacgcccaggggctggtcagtctgaacacgttcatcatcacgtccacggtggataacactcagcggttcactaccgacgaaatgacccctatgccgccgtgctcgcttcttgtgtcgcaccacgccgtcatcgtcggagcctacaacaacatcatcgtgatgaccgagccgatgtggccgcacttgaccaatcccatcactcgattcatccagctaccgcgcgacatcaccatgctcgccagcgttgacaccggcgtgttcgttgctaccgacgaggaaacctactggttgaccgacgttgaaacggacgaaccgagttcggtgcgcaagacgaacttcggcgcagtgcgagggaccgctgtcaagctgcccgatggccgcgcagcttggttcactcggtacggccaagccataggcgatgccagcgggaacattgaactgccaaaccgggtaaactatgctcccgacattgcgaccgatggtgctgccggtgtactcgaacacaacggaaaccagctggtcgtcactaccctgaagggccaaacgaccaccaattcactcggagccggagacttctggcagcttgaggtaatcgacaatgaccagtagcgcagtgatcctcgacggattcattcaccggctcgtgatctgtgacaaggacggcaccgtcgtagatgaagagatcgtccacaacctgattccgcaagtcggtgtggacttccttatccggtcgccattcggcgataccgcgccgatcagcacgttctattgcggtctgttcgccgggaactacataccgtcgtcctcgacgactgctgccgatatcccgaccaacatgcaggagttcacgaactactccgaaacgactcgccccgtatggaaccgagcgtacgacggggtaggcaccatggacaacatcgccaaccgcgcgcagttcaccgtaacgcaggatcgcaccgtgtacggcgcgtttctcgtgtcgtcgagcaccaaaggcggtaacaacgggctgcttctgtcggttgtacgattcgcatccccgaagccgctcaccaccgggcagaccgcccaacttatctccggcatcacgtacgtgccgaccaacatcgtgtgaggacacaaccatggcactgaagtacagctctggtctgcgcaattcgatgatcgccgaccaaccccttcgcaacctgctgaccggctcggtaatccgaatctactctggcccggccccggctactgccgatgctgcgctcggttcggctgtgctgctggtagagatcagcgtgaacggctctggcaccggcgtgagcttcgaaagcaccgtcagcaacggcaccttgaccaaatcgctgtccgaggtctggaacggcacctgtgtcgagactggcactgcatcgttcttccgtatggtacaacccgcggacgatggatcggcgagcaatatcgatccgcgtatccagggcaccgttgcggtgagcggcgcggacatgaacatcacgcagcctaacctcaccagtggtgcggttcagtcgctggaatacttctacctgaccatgccggagtcgtaatggccaacgggctgcgaaaaactgggcaaacgaatacgttccctgagccggccccccgtcccctggccgcccagcgtactgctacaccgagcagcgtatcgtcccgaacgtaaacggcggccagccgatcggcgacgattacttcgggtcgcataacgccaatagcgctaccaactccggttcgtatacggttggcgttccgcagtacactgacaaggttccgcagtacacgtcgatgtggaaggtcgtcaatgtgacgatctgcgtccctgccgtaccgtccgaacccggtgtacctgggaagaccatcgttgatccgaagaccggatggaacgctggcggccgcagcgtaacggctgtcgaaggcgacgcgatcctgaagttcaccgtgccggataaaccgactggcgtccttgtcgggttctccgatggacgcttcgacaactcgttcggtcatccgacgcatgcgttcgctttctatcctgatcggtttcgtatctacgaccgcggcgtgatcatcttcgaggacttcttccgtttctccaaccggtacgcaatgtcgcgcgtcggtgggaaagtgacgttctacgaaatcagccaagccgacgacaccatcatgtaccctatcgtgcagggtatcactccgtccggcggcaccatctacgccgacgctaccctgtactcggtcggcgatttcgtagacaacccgtcgttcggcggcaactcgtctgcgcagcttaatgcgctggtcccgcgtcttcgcccgaccatctacgaagcgacatatgccggtgtcgactccgagcttccgcgaatggtattagtcgcggatgctgtcgagccgcaggtcatcaacggtatcgtccccatgccgctggggaatatttcgaactactccggcgctaccctggtgcgaacgctaccgggcttagtgatgcaagccggtacgtccgatttcgtggctccctggtcctacgtgtcggcgcacatccccaggccgtttggtagcacaaccattctcaccggtgaagtgcttggcctggacaacacgatcccgacgccgcagcggttgatctcggatcgtccgtacgcagaagctggcggcaagtggccgtctcggtacatcatcgacgtttgggaaaacctctggccgccgggcactttgatggtgccggagccgatgcctgtgttcagcaccgccatgctcgacgcaccggtgctgctcatggtcacggatggtatggaggtcagcggcaccatcgacttgatcatgctggtcagcctggatgcctacgactacctcggcctgaacacgacgttcacgttggaaagcaccatcgagctgatgatgcgcgacggactggcggtctactcgaacatcagcaccgcgcgtgaaactgcgctccagtacgccgtcaacgtactgaccggcgcgctgaccacctaccaaaatttcggcttcactggcttcgcccgtgtgggtaacgacacgttcggtatcaagaacgacggcctgtatcgcctcgaaggtgaaacggacgacggtgaactgcttcgcgcgttgattgacttcggtgctgacgactacggcgtgaagaataccaagcgtctgtcgagcgcctatgcaggtatcaccacggacgggcgtgtgtacttccgcatcaccggtgacgacggtgaagagcgtgtgtacacccttgccggcgaaagtcctgagttccgcacgccggacggtgttgcgaaaggcgtcgctgctcgccattggaggcttcgcctggaagtcgaagacgcttcgttcgcggatctggacaacatcgaagtggaggtcggggtttcctcccgcagaatccatcggaggaactgatgcgcctgaccattgacaaaaaagccggtgacgatctccggcacctacctcgtgaagcgcgccgagaaactggcccagtctctcggtaaccttcccatgaagtatgccaccaaggtcgagatcatcgacgggtatatcgttcgcggtgtacgcagcaacatgctcggcaccgctatggtgctcgacaccgaagcctacgtcgtggtgtgcggtaacccgtacaacggcacgtcccgcgcgcagactcaccatccgctgatccgcctcccgcttggaagggattcgttcctcaaacctctaaagcaaccgccggagcagatcgtggtgcaggagctgctgcctagtcacatagggacgcgcggctatagggtgatggagctagggacgttctcgcagagcgtcgccactggtagccttgtgcggccgagtgcattcgcgctgcccgactacgggatcattcacctcgaaaactaacctgaacatgccgcaggtctttgacgtgaacccgttcgcgttcgtatcgcgcgcggacacgttcttctacgacatgcctgtacttgcgccgtcgttcgtgcgtgccacgtacacagccaacgccgaaacgggaaccgggtggatcgagtcggacggcaactaccccggcgaggatgcgccgaagacacaaccgtggtccatgcgtgtctccgactcgatcatgctcgatgcgaacaacgtcatgccgttcagcaaacgcgtgaacccgccgccgtacgaccctggcagctcggcggccaccacgttcaacaacgcgcaatacccgtggtcccgcggcctcacgatcgggcacgggaacgacgaaaacatcggcctgttctaccgtgtactgctggtggcgcacgctgtcttcgacatggttgacgacgaagatcggtacggcgcgcgcggcctgtggatcgccagcttgcagattcagcaggacggtacagcactgcttgtcggcagcagcgtaatcgattccaggcaggaagctgatcaataccgccgtccgtggaagatcatcaacggggattccgaacgctacatggcgaattcgcatttcccgtccggcttggcactgctcgatactggcgatagcgtgctgttcgattccttcagcatcaaccagaccgacccgccgagtgatccgaacggcgggatcagtacgccgtactggtccgtagactgcgcctgggtgaaccaattcggcaccatcgttcgccgggagacggtggccggaccgaccaagggaactattgatacattctctggtgtaccgcacgacatgcagtacatctacggtgctgactcggacggcacgaacgctgtgtgcgtgtttttcagcagcgactttatccacgacccggacgggaacatcggggcgaacgtgagtatcgacatcgtggtggcgaccaaggacggcgtgagtattccgttcagccagatggtcccgttccgcccgtgcaactggttccgtaattccatgtacgggaacatcctgcacataggtgcgggtaagttcctgtttccggtgacttcggaattccaagaaaacgaggacatcggtttcatcgacgggaacatggcgatggctgtgtacgacgtgaacaagaacaccttggagctggccggcgtagtcgaagaggaattgaagaacggcgtgcgtgactggtactacactgggctgatggacgcgccagtgaagcaagtcgtcgacaaggacactgaagaggtgcttatcgacgccacggtgctgttctccatcggcgggaaagcacaattcgccggggagcctgggcctgaacacggcttcacctacatcagctacgactcgggggcgacttgggataagatcgccaactacggctcagcgtctggtgctcggtactgcggaacgatgatcgcgcctcgcaccaaagacatccaggggatttgaacatggccatcgacgatacgatcgactttttgcaggacacggttaacgatgccctgcgcactgcgcgggaaaccacctcccgtatccagaacaacttcgcaccgccgctttcgaagccgtcgctgagctacacgcttcagaagccagtcattgagccgccgccgaatttcggtgacctactgcccggcgacacgactggcgagacggtggcgttcctcgacggcgaggtagagaagtggcttgagcagtatttcccggagctgacggcctgcttgcgcaccaagcctgaagaatggctgtgcggcatcctcaccggacagaagccgttcggcctggacaagtcggtgttcgaagctgaatggcacatcagccgcgacagggaaacgcgcgctcgtgaaagcgccgtgcagcagatccgcgtcgatttctccaaccgaggattctccctcccgcccggtgccctggtcggtgctgtatcgcgtgaagaagaacgcatgtccgatgccatcgccgacgtaaaccgcgcgcaaaccatccgtgccgaagagatcaaactcgacctgatgaagttcgcggaagagcaggctatccggttgaaactcggcatcatgcaggcactggccgacttctatcgccagtggctcgacatcccgaacaaggacttggaggccgggcgaatcaaagccatggcctacagctcgctgacctcggcgctggccaactactaccaagtcgagcttgggttcgagcagatcaggctgcgcgccgctgagtcccgcatggaaggcggcatcagcaacgaccggaacgtgatcgccgcgtccaacgtgaataactcggcggatgccctggccactgctgtgcgcgcgttcggtgacgccgccgctgctgctgcaaacgcccaatctgcgctccaggccgagattgccagcgctacggccggtggaggtaacccgtaatggctgtcactcccgaactcgtatacgacggagttggtttcgtctcgaacttggtcaccgatgggaaccaacgaatgttggttctcgtaggtcgcacgcagttttctttgaacgtcttgtattcgaacgacgctggtgtgacttggaactctacgggactgcctccggcaatcaatcccggtgacttggcgcagattaacggatcgattactgacgggcatcttacgcttaccagctccgggtttacgcccggtgggcagtatgtgagttatctgttctgttctgatgacgccggtatgacgtggaccgaagttgcgatgccgagcggttatagagctttcgtcaccgctggatacgatatcgccatggggtactattggtttgtggtagaaatgcaatccagcccgtggaacagagcgatctaccgtacgcaggatctggtcaatttagaactgatccagatgctacccggtaaccaagaaggtttcactatcacggagttctacaacaacaaggagggtgcgcttagttgggctgggagaaacgcttggaactccagcaatggcggtaatctccttactggcggtattgtcggcagcagtatactcacgcacgttgagtatcctatcgtgccggccaccacgtatttctacgatagtctggttatctgcaaaccggcgtatcctaatgacgggcagatttacctgggcattgacacgagcacttacgagatcgctgtcaacgcgcagcaaccaaacccggcacccgcagcgtacttcgatggtgaagtaggtatcgtatcagcgagcattaccaatgatggctcgaatttcttcgactcgtacttcgctcgcatcggcggaacttggcagcagacttccccgctgcctacaaaccagcaaccggttgcattcgttaaaggattggacgacctgatttacgtcctcggaaacaacggtatcctttcgtcgactgttatcggtgcgactttcacccaggaatacactggattccccagctccggtattctctcgccgctcatggggaaagtgcaggatggcttgtgtgtgttgttcgacaacggccagatttaccgcgtgccgctgctcccgccggaaccgccggttgtgggtaaattctggaccgacatagaatactgcgaagaattttaactgaggactgaagcatggctcgtcaaccgctcggatacggcgtcgaagagatccccgtcgacgagatcgactataccggtggcgacggaacgcgccggcccctgcgccgcggtgaaagcgggctgccgcccaccgcaagcgctgctgacgactcggctgttcgcatccggcagaacgccgcgacgcgtaccatcactgcgccgatgcgtgggcttccgccggaacccatgccgtccggtgtgcaggaggcactggccaagtccaaccgcgtgctcggcggcgcgcagcaggcccgcgtagccccccgaccgtttgggcggcgcagtcggtgcattggctggtgctattccggctatcgacaatgctcgccgcgtatacgagggaaccgaaggtgatcttggacagactgctcgccagattggcttcgatgccgccccactcctgggtgccggtgttgggggtgctcttggcgcggctgctggcggtgtgggtggcgctccttctggtcctggcgcccttgccaccggtattgctggagcgactgccctgggcagtgcagggtacgccgcaggtgatggcgctgttcgttcccttgaccgagctattggagggtccggtgtcagcccgttggaagacctccagcagcgtggcttggcacctcaagccccgccgtgagaacgtcatggtgtctgccgcggacggggatgtgccgactggacccggcggcgaaagcagcatgtcggtagacccgatcaccgggcgggacgctcagggtaactaccccccggttccgtacgctgggcggcaccactgtcgctgagccggtgaccgccggtgctgcgccggccccggcaccggtggttaccccgccggcagtaaccgagcgtgatatcgtcgccgaggctgctactgcgcctgctgcaccggctactccctcccccgcctgccgctgcgccgactgaggcgactgctgtccaaccgagcgcgccgctcggcgcggctacgcccacccagcctgtcgttcgcgcgccctggcggcggtactgacaccgtgcagcgtactactgtcggcggtgtcccgacgttcaccaacattcccggcggggctggtgccgcatccggtacgactggaagttcggctgcgggtgcccgcccgctggccaacacgatctcgtccgccggcgtgccgtcgatcgctgaactcgatgcgcgtgacgctcgccgacaggctgttgccgacgcccgtatggcgcagcagcggatgcggatcaacgaaggtcagatccagagcctgatccgcagcggcagtgccgccgacctgatgcaggcccgtgcgctgatgggcgagaaccgccgactcggtgaaatgggcaccatccgccagggcactgcggacaccttcgtcaacaacgagcgccaggccgagatcggtgaccgtgcgcttcgcgcccgactcggtgctcagaatgccgcgttccagcagctgatgggcctcgaacgcctgcgcatgcagcaggggcggcaagcatcggccgacgacgcgaacttcgccggcacgaaccgggaggacttcaacaccgccttggctgcccagttcggccgtcaagacccggagtccggcgaaaccgttgtgccgcaggctacccaagcattcctgtcgcagtaccaaccgaactgggtacagcagcaggaggctgattacgctcagcagcttcaggcgctgcgcagcgaatcgcagaccaacccgcaggcgcgtgaacgtcttgctgctgtacagcaggcataccagaacttccgccgtggtgtgtaccgcctgaacagcgatggctccgtggccagcctgcggccggtcagcgaaatggacccgactacccagcaacggttcttcgacgcggcgcagacggtgcagcgcgggcagcaggaccagaccgaccctcgtacgctcctgggcggcttgggcggcgctgcactcggcggtttaaccgctgccgcacgtccgtacccccggcggggcgggcggtcagcgcagggcgagctatcctgggcgcagccgccggtggacttggcggtgcagtagcaggtaatgccctgtccgagacgccgaacgcggtggtggccggcggtaatgtactggacccgaccatggattcgaacgtggattcgatccaagtcatcaacggtgacccggtgctgcgtacgcgggacggtaacctgtacaaccttggcgggttccagtaccagagcaacaaccctggcgtactaggccggtcgggccagcaggaagaacgaaccagccagttcgctccgttggccaacgcctacgcccgccggctactccagcaggcgaggaacatgagcgcggatgaccgccagcgtgccgtggcagccatccgtacgttccccggcctggacccggacctgcgcactcgtttggacagcctgtccaactaagcggcgtcctgcgctatagtaggcggaatctcaccgccgacttagcgcaggaccgccatggccactacgccctttgacgaaactcgtcccgtccggccccttggtgacgtggaaacgtcaccggtgcaggcggaccccaacctcccgtacaaccctacgagcttgaccggcgcagctgtgcggtcggggcaatgcgcagactgccgcgctgtccgccgattacgccggcaccctggctgaatccgccgggatgtcttctaccgcgcagaacctgtacaactacgccgaccggaaaatggccgaggcgcagtcgcagcaggccggagcgcagcagcttggggatatccgcgacgcccgtaccttgggggaattcgtcgtcaacgccgctggtgaatccgcaccggtgagtgccgcggccctgggcgctaccgctatcggcggcccgctggccggcggcgcggctgtactggcaccgaccgctggtgaaacctcctacgccatgcggaccgatccgaattccactgctacccccactgagcgtgcgctggcctcgaccggtgctggcgtggtcagctccgggctggagatcctgcctgaagctcgtatcctcggccggcttggtcgtgaagctgccggcggcgcggcacaaagcgctgctggtgctattggccgcggggcgcgggagttcggtacgtccacggcgttggaagggctgaccgaaggcgcgcaggatgtgatcagccgcggtgcgcagtcgttctacaacccggagatcggagtgaacccgatcaccgacgaagaagctaggcagtcgttcctcgaaaacgcagctgctggtgctgccgggggcgggccggtggcggccgtcagcggcacgaccactgccctggccagtatgccgtccaggctcgatgcacgtgctgcgcgtgcgccggacactatcgaccccagtctgccggttgaccagcaagccgagcagagcttggcccgcgatatgctgcgcagccagcagctcgaactggagcgtcaatccttgctgaaccgcacggacctcgacgatgccacgcggcaagaactagccgataccgtgctggacctcgaccccattgctcaggagcgtgtcgcacagctgtccgacacgatgcaatctcgtgatgccgcgcttcgtgagttgaaccgcatgcagcctgaaggtgtgcgtgcgagccgccgcgcgccggtagccgggttcgagcaggtcgatcgaatcctacagggtcaggaagcaagtcacccggcagtccggcagtacctcgacgtactggctgaccgcgtgcggaacgggcagatcgacgagaacactatcgacggtgcattggacgtgttcggtgagcgtgcgtactcggtcctgaacgccctggaaccgaacgaggccgctgcgcgcacaatccggcaggaccagcagcgtcgcggtgacttcgatcagttcctactacaaagcctgcgccctgagtaccgcgacaccatgcgcccgcaggatctccgtcagttgtcgaatgcgttgcgtgtcgaactcaccaccggcaccggcgagctgcaaccgttcctcgaacgcgccttcgccaacccgcagcaggtgctcgacggcctggacgccagcctgcgcggtgagtcccccagccgtagcacaagcgaggtatccgatgctccccaatctgctggcgctcttgacgatgaacttgacggcggggagttcgatcaagctcgaaccgtcgagtccgccgccgagaactggttcggcgacaccaccgggaaccgccggattcaaactggcggcctcggtatccccgccccaattgcccgcgccgatacacaacgacttcagcgtgctgaagaagcagctcgaagagcgaacccggatggagctatcgaacgcgtgcctgccgagcgagccttgcgcgaactcggcgtcgatcccgcagacgttgcagcagaacttggactgtcgcctgacgccctggcaagttcggtccttgttcgggcagtccgacccgacgctacgggtgcagcacaagcccttcgcagtgtacgacagcttcgtcgttctaccgttgagcgactgaaccaagagccgaacaacccgtccgccggtagctacatcgctgccacgtcgccggagggcacgaacgtggccgtggacctgcgccgtctggtaggcgcgcaggtattcggtcgtcgtgacgcccaggcgctacgtgacgccctgtccgatggcttgggcaccctggccgccgccggctaccagttccagctaccggacaccgccgtggtggcccggtacaaggatgggagcggcgaggtagcagtcaccgtggcggacctgcgtcagggagcagaccagccgcgcgccggcctgcctcgtgacgccattggcctggatagcccaaccgccgaagcgctccaagacttggtacaaacgtacgaaaacccggagcgaaccgtgcaatatgcacgacaggcggacgttgagcgcctgatcgacgaatacgccgtccagacgctcctgggagcgcttcaacggcgagggggtaccgctacccttcccgaagccgcagcacgtctcctgcgcgctgccagaccccgtggcgtggctctggacggcaatacggccaccctgaccggcgaatctctgcctccggccatggatttaggctccctgcgcactcctggcagccccatcgacaccctggccaggaccgtcgccgaccgcggtccgatgcgcgaaagcctgcgcctgctggcccagggcgctgcccaggcccaagacccgtccgtgcgcgacttctggcagcgccagcttgaccgccggcctgctccggtggacaacaccggcaccgacgagcagctgcaacgccggaacctcgaagacttcgctgcccagcagggcatgcaggaactcgacccggaacgcatgcaggcgcagaccatagaagccgccaccgggcgggaaggtgcggccgcacggaacgaaccgacgccgataggccgccgccggcctgggccttccccgttggacttcggcgcgcacatgaacaacgtcgccgccagcgtgcagcagcggtcgtggatgaacaccacgcagacgaacgtaccgggtgcctgggccgcgccgatggcagcagccatgaacggtacgccgttgaaggtcgctttcgccctgaaccgtagcgaggtgcttcgcagccgcgacgccacgaacctgatgaacgcctacacgcggacgggggttcaccatcagcgggacgaggctcgacgtggatcaggataccggcccgtacagcaagagcgcgtacgcgcggatcttggggccgactggaaccgaccccgtagatgtggtgatcaccgccggtgccacgtacccccgccgtcatgctggctcgtcgtcttggcgtgcccgtgctcgacattaccgtgccggcgcaggcgaagatcgctggtgatctggcccgtgccttcgaccgcgccacgcgcgaagacctgcacaatcgccgggaatccatgaacccggtggcgaaccgggaagcccgccgaagcctcgacacccgccagggtgttcagcgcgcgcgggacatcctcggcgcagggatcgacaagcagctgtcggcgcaatgggctgacccggcggcgaccgagcggctgctgcgcctggggcgcttgtcgttcattgctgacgacgcattcttcgaggctgggctggctgggcgatcggtgacgtacctgtccgataacatcgacgcgttggaggcataccaccagcagtacctcagcgagacttcccagcagatcgcccggccgcagcaggatgcgactgaccagcagatcaccgccgttcagaacatcatcgtgccggaggattacagccggttggatacgccggagaaggtcatcgcgttcgctgagacagccgcgcgtgtccgcgacacgctgaaccgccaagacgctgatacgctcaccgaagatcaagctcaggccaaggatcggttgaacgacatgtttgctcagggccgcgcagccgtgttcgattggaacagcttgtgggatggcttgaacccgactgagcagcagcggcagcagctcaccagcatgacccggcagagcgcccggccgcagggtgcgagccgaatgagccagcagcaggccaaagacctgaacgactacatcacccgcgtgctgccgagcgatgtcatgttcagcatcgagaggctgccgggtatcagcggcatgttcaccgagaagctggaccctacccgtccggacatcaacgggaacccgaccatgcagcggttcatcaaggtagcggtcaacgccgccagcccgatgtccacggcgttccacgaatccatgcacgcattgatctccgtcctgcgcgggcagaagcagcaaagccagttcatcaaggtgctggatcgcgcagcaagtaacccggtggtgctcggcaagatgcgctccctgctggccaacgaaccggccgcgctcgaacagctcagcgacccggaagaacgcatcgcctacatgtacgagttgtgggccagtggcatgctcgacattcaggcacagccgcagacgtggatgtcccgattcgctggatggattcgcggcaccttgtcgatcctgaacaacgagcagaaagccgagctgtacctccaggcattcaaggatgggaagctgcgccggccgagcgctgtcaaccgcgtggtgatgcagtccctgtccggcccggagcgcgccctggtaagcagtcgagtggctgaccgcgtgagtacgctcaccgggaagttcctgcgtaccgcgcacggccggttgaagaactacggtaacccggcgttgagcaagatcgctgaccagttctacgcgcgcagcgatacccagggccaacgcgccgggtacatccagaccgtgcgggaagtgacgaacctgttcggtacgcagctggccaacatcatcaagaccatggacgagcagcagttggcggacctgtccgcggcgctgcacaggaacgttcgaccgactgacccggccctggcgcagaagtacgacgacaccaagtcgctgctgcgccggatcttcaactacatgaaggtgtccggcgtcgatgtggcgaatgttcaggactatttcccgcaggcgtggagtcgggaggcaatcgacgccgacttcgataacttcgtcgatgcgctggcgcaggtcgggcaggtacgtgacgacaatgggaactggatcgacatgacgcccgacatcgccacctccgtggccgagacgttgaccaccaccgaggggcagctggcgctgagtgaagacttagccggctactccccgtacatgcaggcggtcaacgaacggaagatccggctgaaggatcgcgcagtcgtcgcgcagtacatggacccggatatcgtccgtgtgctgacccgctacgtcacccaggctgcgaagcgcggggagtacacgaagcacttcggacggaacggtgaacgcctgaaggaccagctacaagaagccaagcggtacggcctgacggacgagcagatcgaacgggatgtagcgccggctatccgtgcgctcgaaggcacgctcggtagcaacatcgatccgcacctgcgcagcgccatgtccggcctgatcacttggcagaacctcgtcgtgctgccgctgtcgatcttcagctcccttatcgacccgctgggcatcgtcgtacgcggcggggaagtgagcgatgcctggaccgccttcaaagccggcgtacggaacatcccgcagagcctgcggcgcaacggcaacaagctcgacatccagcgcttcgctgaggatgtcggcaccgtggaagagtcgttcgtgctcgacctgctgggtgacatgtacggctccaactacatgtcggactgggcgcgcaagaccaacaacctgctgttcaagtacaacctgatggaaggttggaatacggccatgcgttcggcggcgacggtggccgccgagaagttcatcattcgccacgccgcgggcgtcaaccagcacagcacacgctatctcgacgagcttggtatcaccgccaaggacgtgcagaccgacgcgaacggccgcttgctgttccgcgcgcaggacttcatcaaccagggtatgaatgcgaaggacgctatcgagaaaagccgtctggtacgcgcggctatcggtcggtgggtggacggcgcagtcctgcgtccgcacgcggctgaccgcccggcctgggccagcgacccgcactggatgctcgtgtggcacctcaagcagttcacctacagcttccagcggaccatcctcgaccgcgccacgcacgagctgcggaacgggaactatgcgcccatgctgaccctggccgcgtacgtgccgttcatgatcgccgccgacttcctcaaggcaatgctccagggcgcgggcgatgaacccgactggtacaagagccaggacgccggcgacctgatctggaggggtgtggaacgcgccggcctgctgggcgtgcgccagttcgccactgacggtatcgaaagcccggcgttcaccctcggtccgaccttcagctacatgctcaaggccggggaaaagacgatggatggggacgtggacgggggccgcgctgagcgctcttccgggtaatgcgctatggaaagattggattgatcgataggttccagggcggaaatatcgccctggcgcatttaaccataatcgatattttgagaaacgttctcaacaagagaggtcgaacagggccaagatcgtaacatcgtgacagcctgggtcagctggaggccgcgtggcactaggctgtcacgaatgtcacgaatgtcaacgaaaaaacttttcggagctggagcacatacatactaccctcgtaccccccggcggccctaagtatctatattctttatatatttattttatttttctgtagtggaataaagtagtaagaatcgtaacatcgtaacagaaatcgctgtaagccccgtggcactaaggctccagcgtgttacgaaattttggcctgttccgaaaatttcgtaacatcgttgcaattaatagtagtgctctggaccatcaacggtatcgatacaggctgtagggcaccaaataggcccgtggtgcgcttcagttgtggaaccgccactctgctacccctacggcgggaacgtgcagcgtggcgcagctccgggccggctggcatactttccgcagctcacaggaggccgcaccatgacttgcaccatcgatctacagattttccaggggaagacgttcgaattcgccttccgctgggccgatccgatcaagctctacaagcccatcacgggcgctacggccaccgccccggtcgtgctgacggtccctgggcatggcctgtccgatggttggccgttcgaggtgcagagcgtgaaagccccgcctgagctgaatacccagcctgggcagttccatctggctaaagtcctgaccccggacagcctggagctgaacgacgtgaacggcatcggcttcaaggcgttcggtggggccggcaccatcgtcttctaccacccccgcggatctcactgggctggccgcccggttcgccatccgccggacccctggtgatgctgacgcgctgctcactgggaacaccacggacggtcgcgtcgtgatcgatatccccacccagcaccatcagcatgctgatcggcgcggacgtgaccgccaccctggactggaacaaggcgctgtatgacctcgaactgtacgacccgaccgacgtgtcggtggtgtacccggtggggtccggccgagtgaccgtcacggccgaggtagcgaaatgaacgcaggtcaggctctagtcgtccgccgggtcggccagtgcctgtccgtggcggtatcgacatcgcaggcgcttgtcaccagggagcgctcgcaggcgctgctcgtgcgtgaccccgaccatggagatcatcctgcccctgtcgcggccagcgtcgcagctggagtacaccaccatggtcctgccgcctgcgcaggccgttaccgaggtgctgatccagccgggggcgcagcaggtgcaggacttgcgctcggcggcgttcgtcgtcctggctgggcagcctgggcgcaagggcgacaagggcgaacccggcccggccggcggcgcaatcatccagaaggtggcgtcggtgccgatgtccggccatcgcatggtcgcaccaatcgacgccaaccaagtggtgtacgctgattgcgcgacgctgatcaatcgcataaacaccctggggttgtcgttgaacgcagcgtcccctggcggcacagtggatgtacagcgcctcggtgaagtgcagcattccgggtgggcgtggacacccggtgccgtgttccttggccaggatggcaatctcacgcagaccgttccctctggcgcgctgttctcgctgatcgtaggcttcgcgctcgaccctactactctatttatcgacattggcgtggcgatcacgctggaggtgtgacatggcagacaagtacctttccaaccagaacggcttccctaccgaagtcgaggcgaccgtcgtctcggccggtgtgggtaacgctggcgacatccctgcgctcgactctaccggccgcctcgacagctccgtgctgccgaccggtatcggtgccgacaccgcgatcatcgaagcgtccgaggcactggccgctggtgattacgtgaacgtgtgggccgacgctggcgcgttcaaagtgcgcaaggccgatgctgctggcggcactgcgaagatggcgcatggtttcgtcctcgctgccgtggccagcgcagcgaacgccactgtgtacttcgaagggtcgaacacccaggtcaccggcatgacccccggtaacgtgtggctcagcgcgaccactcctggcctgggcgtggcgactccgcccaccggcaccggccagatcgttcagccgctgggcaccgcggtgagttctaccgtggtcaacgtagagatcggtcgccaaccgatcgtcctggcgtgaggtgacgcatggctgcccgcagacctctcgtccacggtagcggcttccctcgtgagctgccggccggcgacacgcttctcggtgtacctctcggcgtgctggtgtacatgcgcgccggtggcacccttcgcgtgccgttgaacaacaaccagatgctcccggtggcactcgctgccggcggctcgctcagcgtaccggtggtgaccaatggctgatgcaatccccctccaaggtaatcgacaacggcggcggcaacgggaacctgtcccagttcgccaccagcgacaccgtacccatcaccaacggcgggaccggcgcttcaactgcaaccgatgcgttcgcagccctggctacggcacgggtgaacaacttcgcgggtctagccggcggcacggacgtgctgccgtatcagaatggcgcgaatacctgggcgcagacaccgatcactgttgtaggccgagcgattatcaacgccagtacgcaggcaaacgccttgaactatatcggcggcgtacctaaaagtatgacgttcaaccgagctgtttcggacccgaatacggtccctgacgaatgcgggttctacggtatcggtacgtcgccctggtcgaatctgccgccgggtatcgattcgctgaaccctatcggttcgatgctctaccaccacccctacgacgcagcaactgcggtgcagctgtttgtaccgcggacttcgaatatcttctacttccgacgcaagggatctggtacttggcagccgtggattcgcgtactgtccgatgcgcagcttcttggtacggtagctcagtctggaggctcgccgatcggttcgattcttgagcgcggcagcaacgcgaacggggagtacattcggctcgcagacggtacgcagatttgttggttcaacgcttccgtcaccgatcaggcggtcgatactgcttacggcagcttgtttaccggcactcgtgggtggtctttccctgcaacgtttgccggtagcccgacggtgagtgttggtctatttcgctggggtactggggcaggctgggggacgtgtcggcggggttgctagtgcgactagcgtgacgttgcggatattcgacattgcttcgagggcggccggaaccgcgacagcaatctccgcgatagccaacgggaggtggttctgatgatcatcaagttgtcgccgtatgcaccgcttcccgatagcgacgagcatctgtcgctgagcaggactggtgatgtactcactgtgaacgatcaggagttcgattttacgtccgctcccggagggtggtgagttgccgtccgaggctattgagtcggaatggttcgtcggtcctgtagtacgaagaaatggccggctggagttgactctgcgctacccgcttggcgtggatgccagtgaagccgcccgcttccctgaaccgttgattatcgaggtcgacggcccggtggagttaccgcgatgattgactggagcaaggtaaagaccgctgaacagcaggcgcaagagcgctggcaagctgagtacgatgccgcagccgtcgcacgggcaaatgcctaccgcctggaaagtgatccgctcaagaccgaggccgagttcgacgcgatcaagtccggaactgaaccggactacagcgcctggatcgccaaggtcgaagagatcaaagcaaggtatccgctgccggagtgaaaccccgcaccccatagctctgtacagagcaaaaaagaaaacccggcacatggccgggtttctggtaaaatgagaactgcggatggagccttgttatcgcatttccttgcggtgcaagaaaaaacccggccactggccgggtttcttgtttctggaggacggctactcgtcctcgtacaacgactcgatcaagatatcgatctcgtcacgcacttcttcgagcagttcacgcgtttcttcgcgcgaccgcgacgtgtcgccgtagaagccacgcaccgcttccatcagttcgtctttcgtcatcccatcagctccttcagtagtttcaaggttgctatgaccgcgatgcggtcgttcaagtcaccgggcatggcgcgcatagcgagcagcatcgcgtcgatatcttccttcgtgtcgacgttgcacaacgttcgcaatgcattcacggcgcgttccaactgctcgcgaattttcgcgtcgttgggtttctggttggcgaagcaatcagggtcaccacatgctggcccgccgtggttgccatcgcaggaggtatacgccgacacgatgtgcagcaccagcagtgcgtcagcgccgttcactttgagtgtcgattccttgaggaattccgacagtacctctttcacgccttctcgctcggcgatggacttcatgaagtcccaggacaggttcattgctctgcgcctccgtcactgtctttcctacgcatggctgctcgatccaggcgctcgatctcggccaggatcagtccaccggccttgaccagatcgcggcgtcggtcgccggtcttcggctcccagccttcaggcacaatggcctcgcccagggtgtcgccgtacccggtgctgctggcgtcccagtcgcgtgccgccggcggcatcgcgtagaagcatgcgaaagccgcgatctcgtcgcaggtgtgcgcatcgtcgtgctccggcgtccagcccttgacctcgacctgccggcggcgctcggcttgaacatcgagccatgcttgcggcacttccgtgccgggcgcggcggcgagcacggccagaagctgccgctccgccataattctggtgtcgtggtctttgccgctcatcatgttgagcagttgctcaaccggcaccagcatccacccctccgtcacgctgtgctgagcctgggctacaggggcggtataggaggggagttaggaactcatacggcggttcttccgcccagagcgacggatggtctaaacctatatagatatgaccaccgtcgggcatgcacgggtctagcagcggctccaagttcttttttgcgggcgtaccctacgatttgcgggtgctgtttgtaggtctgcttctccagctccgcgacgatgcgctcatgcgtgggggtccgacagctttcgttcaccttcgctacgggtcggatgtaccgcgatatgcttggcgatagtctcccggatgacgcgcagcgcgttcatggcttgaagtgagctgccgtcctggccgagcttggcggtcaagtcgatttgcttgagtatgctttcgatcataggtcacctttcttgttcggcggcgtaccgtcgaggaacagatcgtctacggatgttgcgtcgggatttatttctgccccagggccgagcgcttccctggtcaagcgttctgcgttgctgtcgtacgcttggtcattatcaccgcgcatacgccgtagcgctttccgccctacggtcacagcagctttgtagtcgagcaacatctggttgaacatggtgtccgatgccgctgctttcttcccgccgcgctccagcagggatatggccgccacgagcgatgacagtacgcacatcatggcgtcagcgtctcgtttggtcgggatcttcaaccgctccatcgcgccgagcgctttgtggtacagctgcttgtagcgagcgatctccgcgtccttgtcttggtacgttttgctgaggtgttcccgcacaacgttcgtgtagtccgttccgggataccaatcctgtccgcagttcacacagacgttgtagctgccgtgcttctcgaacgttctgcacccacactcagggcaatagttccacatgcttcactccaggctcagtagacgctcgccgagtttcacgcgcatatgcaccttgtcgcgcggtataccggtgagggtcgagatttcagaaagggtaaagccctggttcttcaaccgggctgcacgcttcgacagttcctgccggcgtttcgtcgatccgatgcccctggccatgtaagcactccacgaaaatctcagcgccgtagtgcgtgatgtacccaaccatccctgggcgatgcgggaacggtacaccgttgcagcggcataacctaccgactagccaccctcttctgtcggcccatttatcgacacgcagcgtgccgattttcccgcacgctcggcaccgagcgcgtgcgagtccgaacttcagatcgccgcgcttggtgttccgagcgccgcattcacggcaccggcagcggaccttagccttccgcggccttttcactttctaccttatcgacggccgcgttgaacttgtccgcgtcgaaccacaagatcagcccgatcttggtgccgagcacgaagtcggtcggtgtcatggatttcgtgacgaacttgatcacggtttcgtctttgacggtattggctttgagcgtggacttgttaagggactgcgcttcgatgttgtccatgccgatcgcttcaatgagttccacgatgttcatttgcgcgcctccttgttggccacttcgaggaaacgcatggcgtcggtgagctgcgcttctgcgtcggccagtgcgtcgtgcccggtactggcctgggtacgcccgaccaccatgcgtgccgtacgaacatcgcgctcgttgaagaagagccacggtttacagccgaggaaattcgccagcatttcacagtcgaacgacggggagttaccccacacacgcacgcgcgggtttttcttcagcacgccgtcgaggaacgacatgatttcgagcttggcgtcttccatgccgtacttccgcttggccatgagttcggtcattgcgccgcgcgctggttcaccagcgccggggccgagccaccacatgatcgtactcgcgtcgactttacggccggcggcgatttgctcggacggatcgattgctatgtggaacttttcgccggtgctcgtcaccatcgccaccgaaaggatcaccgattccacggaggttccgagggtttccaggtcgatagacagttccgtaggtatttgctttgccatcacgtaggctccgaatagtgaggtatgtcgccgcggaaaatgcggcgatcaggtacagcgaccgagcgatcttcgccccggtatacaagagaggaattaaaggcggcacaggtacagctccgaacgatgaactcggcgatcagttcacgcttgatgatgtggtcggcatccggtgcaggtagttggattttccgttcgccccacgacaagtgcgtgtagatcaccccgccgaattttgcagggaacagcaacaccacggcgaccgcgcgccccttgcggtacttgtccgcaagccagatacgttggttatccgacaggtcgagcgtcaccgcccgttgcgggggctttgccaggaatttgtactcgacccacaaatcgcacggccacgcggcataccacacatcagctgtgccgttgctgtacgggttgctcattttttcgcggtggacgaagctgggcagcttcgtgtgcaggttctggatcgcttggttctcgggattcgccatgcttttctccagaaggtaaaaaaaggccgcccggaggcggcctgatggtgcgtgctggcttagctggtagccagggcggcgagttccttctcggccttggacagatcggaagccagcttcttgtcgttggcgtccttggccttggtcagcttggccagcgccgaatcaccttccttgcgcgccttggccttgaccttctcggaagctgcgagtgccttggtgcgctgcttggtcagcttgtccttcgccttgttgaactcggcgctgagcttttccatttccttgtccagcagtgcgacaggcttggcagcgtcatcctgcttcttgtcgcgttcagcgcggatgcgcttgacctcggcgtcgtaatccttctgcgtctggatggccagtttacgcagctcggctacgcgcttttccttggccttgatctcggccttgctaggagcagccttggccgccgcggcagccggcttaacgctgggcttttcgcgcgctaccacggttccttttaccggcttggcgtcggcgggaatcgggttgctgctcagggtcgatactttcggggttttgttggcgggttgacgtgccatgctcgtggttccttttgctttcgattttcgattggagttggatcagtttgttgtccgcagcgagctgtgctgcgcgggagacgagacgattgagcaccgagcgccgattcgcgccctttaactccagatcgacaagtcgctctatctgctcggcgttaaacgtcggcagttcacggtacagctgtcggatcgttcgcagggcactcgccagcgtggtgctcattcgttacctccttggtttagcgccgggcgcgaccagccggtttcgcagccggacggcggccgccggcaggcttgcgattggcttgacgctcagcacgctgcgcttcgaacccagcccaatcaggctcggccgtcagcatatcttcaacggcttcttgcagaccgagaacttgcgccagctggtcgtcaccgaggacttcatccggtgcaaaccgcaggctggcccaggtcgattgcgcgtcgaagccgatcttggtgacgacttggacaggcagcagatcgttgcgggttgccagattgcgcacgtatccatcccagtgcttgataccggtcggcgacacgttcagcgggtagaactgaagatccccttcgcggttctcgtcatccagctcgtccatgagcacgacggccagcttgcgggtgttcttgcaggctttgccgtcgccactgccgctgccccactggttcaacgggcaggtggcgcagtcatccgcttgcttctgcggggacttgtccgaggcgatcaaggaatccgggctgccgagcccagcggcgaagcagatcggcggttccgggttcttcggatcgtacgggccttcgtacagcgagttgacggaagcgaagtcgatcaccacggcacggatgaactccggtgcctggacgatacttccgtccggcagttcgaaggacttgtcgttgcgcacggcgatggtgggagtgctgggacggcccagcttatcgagcacctgctgcttgcgagctagcagctgtgcctggagtgccttggcatcgaccggcaccttgctgcctttgccgatggtggctacagctttgccggcagcaggcttcttggtggccggcttagccggggcgtcggttggttttttggttagccatcaggctgtttcctctcggttacgttgtgagctttgcttacgttgtgagcttcgaaaagccccgccgaattacttcttcggcgggttgatcagaccgaccttggtcttggtgaaatcgcgcaggccagggacttctttgcccttctcccggaactcccggtacgccgtcaccgtcaagcggcgttcgagcatctggaagttcttggtccgggacatccatttatagaacgcgtcccagtcctcggcttgcggcaccacggagtcttgcagcttgactcccattccgttcttcagcgtcacggtgccgagctgttccatgttcaggtgttcgatcagctcttcttccaagctggccttgagcgaggtcagttccttgactttcgcgttcaggtcagtgatctgcttggagagcttgtggaactccttgatcgcggcatcgcggtcgaaagagattgtaggttttttcgtttgccatgttgcaactcccaaagtaacaattacagacgaagttcgtactgctcaggttcatcggacccaccgaagagacactggttctcgaacggatggtccggccaccacaagttggacttcttgaggttcgggcctgcgcctatgatctgtaggttccatggaacatgcagaccacaaaccagcttggaacagatcggcacgatgtgatccacatgcacgtcctcgccagcactacgacggcgcgcggcttcgtcgtagattttcttgaatcccggatgatcggcacaccacttcggccacgccaggaacagctgcctgtagtagcgtaccgatctccggtagttcttattgagggaagggtcgttcgggtcttgcagtgccagccagttggggttagttcggctcttcggcgctgccatcctcggttccttcttccaggggtatcatcaacgtcacgccgtagcgactaccaccgagcgtgctcaggcaaagttcgcactgctgccagctgaattcattttcgccgattccatcggggtcatcttcggtcggctcgacgccgcacacgaagtacgcattcttcgcttcgccgatctctcgttgcatcgcggcttctatgtcggcaccgttctccggcggttcaccgttcgccacgaagagcaagcaatcgttgcatacgctgtactcaatcttgtcgaacttcatttcgccaccttgtaaagtagggaaaggcaatgccgcaatcttgtcgagcttcatttcgccacctcgtaaagcagggtaaggtaatgccggcagtaacgtttacttctcttggtgtacagacaggtcagaccgtcagccttggtgtagcgctcgtcgtactcggctttggaaatccttcgcatcgcgttgcacacctgcatgtagtacgtgacgttgcccgtctgcaaattctcacaccgcattagttcgctctggtacaacgtcacgctcatttcgatctcctacttgcagtagtacggggcgtccttcacttcagtcgccaccggcaggtcaggtgcccaccagggtgcagtggacatcgttttcaccatgaacttcgtggctctggccagcgccgtcttcgtagcccggaccagcatcgacacttcgtcgtgtgtggtcatgaccacacggtaggctttcgccatgagccgcatctggtcacccactacgatccgcgccaagcactggacgatgttttcagtcagcagcccgccgtagattttcttccggctgacgttcttcccgcggacgatcgagtaggtgtagccgttcttccgcccagtgtcctcgtcgtactcttcacggagttcggggtaatgcaggcacaggccattcggcatccagatccggtcaggttcgtattccaggcgaagcccgcactggaactcgatgaacccgctgttaccagcagccatatcggccaggatgctgtcgaggtacttccacaacgccgggatcatcgggtacttcgtgcggtacgtgttcacgacgtgcttggcgtcttcgacttccatcagcacggggatgaagctggtcgccatcgtggtgatgaacttcctgaaccccatgccgtaacccaggccgaggatggaagtcttacctacgtgacgctcggtttccgtatccgggttttcctttgcttacctcgacatccgggtaaatctccatggcgaattcggagtacacgtccgcgccgacgcggaacgcttcgaccagatcccactgcccagctatgtacgccagaattcgtgcttcgatctgcgccgagtccccggtcatgatgtgccagcccttcggcgcttcgatggctcggcgaagtgccgacccgcgctgaaggttctggaggttcatcttgttgccggctgtccagcgcatcgacaatgcgccgcagtagccgtacatcaccggcagcagtgctccgtcctgggtagcgtccagcaggcgctgcgcacgtgtgacggtctggttcgacgtgaactggagccgtgcttcacacagaagacggaccagagggtcagggtcttcgcatagctcgacgaaccctgtgtccttcttggccagcgccggtatccacaagcctttatcgttctgcttcatcggcacttcaacgccgagtgcttcaagcagcagcgggaaatcgacagcggatcgaagcaccgtctcgaacggacgcttggcgttgaccagccccggagcgagggtgttcaccagttcaatcgcctgcttgtacaagaccgcgcgcttggcttcgacttccgcaatcgcttcttcgagcatcggtccatttacgcgaagcaccgggtcgcagaagcaacgaacggtgtcgtggatgatgtccatttcgtcgtccggtatgtacggacgcatggcttggtagatgctgtacgtgtcttcgcagtcgtcgacgcagtacaagcccaggtcggtcagttcctggcgggtcagatcacgcttgccgaacgtgttgacgttggcctgcgccttgaccttacccttgagtccgaacaacttcgccacggtgtccaggccatgcgccgtcgtgttgcggaacaagcctttggacatcgacatcgtacagcgatatgccgccggcacgaagccgaagaattcgctgaggatcagaccgtcgaagtacaggttgtgacctatcaactcgatctcgtactcagcctggatcttggccagccacgcggcgaacttcttcatgtcggtgaagatgcgcgtcttggcgttgcccagcttggcacctacgcagtggatcttgaactggtcaccgcgaacgtagtcgctggtagacatcatgcgcagggaatacttcggaccccagtaggtttcgaagtcgaccaccagcggtttgaacttcttcagcgggcgtagcgtaacgggtttcatcccgtcatggatgcgcggaaccataatcgtcatcgcaacggtccttacgtgaagtcgcggatgtactcgaacatcgtcatcatgcgcttgcctttggtcgtgcagacttcgaaggctttggcgtcgagcgtgttctcggcgcatatcacgatgacttcgcaatcctggctctggccggttcgataggtccgtcggttgagctggtcgaataactcgtagtcgtaggtcggagtggcccaaatcgtagtcctggcattcaccagggtaaggccgtgtgcagccgcttgcggttgaagaagcagatcatcgatctcacctcgcttgtgcgcttcgacgatagctttgcgtttctcgcccggtacggtgccgtcgatgtacgcggtggttcgtccacgcttcttcagcagcagttcgagcgcttcacgctggtggtgccactggaacgcgatcagggttttctcacgttcttcggccagatcagcgacaagctcgtaccgctgcatgtcgagcagggtgttggccttctggttgtcgtaggtcgagccgctggcgatctggagcagcttctgcgcggctgccccaccgttcgctgcggtgatcaccttgtctttgaggaacatggcttgctcccgcgccatctgctcgtacaacttgcgcagctttggcggcagcttgaattcgatcgtgcgaatgctctgcttcaccgtggtggcgaagaggtgacggatgctgatgtcctgcaagagctgagccacggccaagtctgcgccttcgcgtggctcccattggatcatgtgcgcttgccggccgacttgcaccgggtagcaggttgcttcgcggaatcggctgaactgccatcccaggcgtttaccgtcgtcaaggatcagcgtcggcgcgaagtaatcggtgatcatcttcgcgccgagcgaaccggacagcagcgctttgaactcgacgttccgaaccagtttatggcagcgcttcgtgcgcttggcctgcgggtttttgaaggcggtggcctcgtcgccgaggaaccaatcgatacccaacttccgcatgaggctggggttttcggacaggtactccagaccgttgtagttggtgacgtacagatcgtgccccggttgaaatgccttggcgcggttgctggcgaatgccacgctgatatcgacatcaggatcgaccagaccgacttcatgcggccataccgtatcgatcaacgacagcggcgctacgatcagcccagctccgcccccggccttccgatgctcgacgaaatgcgttgcatgcgccacggacttcccggtgcccggttcggacagatccagtaggatcgaagtttcgccgcgcttcttcagcgtcttcttctggtgcggcatcagtttgatcggtttgaactttgccatgagtcctccttcacgcaactgcgggctgggaccgcagcttcgcgcgcatgcgggtagcatggaacagctcggccagggcacggtccgcacgtagatggtcaccgaggtagcctttgaggcggttcagcatgtcgtactggtagcggttgtacatcaccgggtccgggcgcagacccatcttgaaagaggccatgcctacgcggtaatcaccgtccgactggtcgatggctccgtagacaaaacgaaaccctgtgtcggacagggctacgtcgatatcgaaacgcttcttcagttcagcgtacaggttcttcatatcttccactcagaggcccattcgttgcccttcacgggcgttttttcgttctaccgcgtgcggacagatcccgtccttatacgggcagtaccggcagctatagatgttcgccgccggcttgaattcggtgtcccgttccattttcccgacgcggttgtggaacgcacgttggatagccgggatatggttccgggtgaagtgactggtcgatatctcgtcgatatcgagataccagagttcggtagtgactcgttcgaggaacggccatttcttgaaggcggccagggcatagagctgcatctggtccatatgcttggtttcgtacttgcgcccggtcttgtagtcgatgatcaggagccagcgatctttgacgatccagacagccacgtcgacgatggcgatggcggctcgctcttcaggcgagcagggttcccaatcttcgtcgaagcaccagtcatgctccagcatgaccaagccagcgcggaagcgttcttgcaggtcttcgatcaaggcttggaagtcagcagattctgccggcagcttgtccacttcaccgcgaacgaacagttcgttctgctcgtggacgcgggagccgcggtcgttcgcgtgctcagacttaccgaggggggagggggcgttcaggttcgggaactttgtcgatgtacttcagtttgtagcggtatgcacaaccttcgcggacgtgcagcttactgatcgaccagcgcatgagggtagctccagggattagtctgctgcattgtacattacagcgtaaacaaaaaagccaccggtttcccggtggcaaggcggggtgtttacttggtgatgaccggcgggacgcctttgttcagcatgctgcgaacattggccgccagttcgacaggcgcgatatcctgcctcttctcctgggctttggccggcaagaaccgcattgcttcggggaacagttcttccaactgcttggaagtgcggcacgcacgcagaagttcgagcgcttgtttgcggaagtcgagtgctgcacggatcacttcgttgatgtcagcgcacagctcgcccatgggttggtggatacccgcgacctctatggttttggtggacatgccattaatgcgaggcaccgtagcaggcgctacgaatttcagcttgaaatcgtagttcagctgatattccgtagtgatgaacttgttgagtggcgcaaaagcgtcggaactcagcaggttgcgaacgagcatgctctggtccggggtcgtcaacgaacttttgttcgtatataccccatatactctggtagaggcatcttccgatcggctactacggtattgacctaacttcgtttcgtagtaaaccgggatggtggtcaatacagaagtgcatacgccatttgcaattaggtcaggccacttgtcggaagtaatacccattgcggtcacacgttctacgtgcgtactccagaacttgtcgttgagcttcgtcacgcgagcgatcagatccgccgctttcggtttcgctgcctcgcacatgagcatcgaagcgatgtgctcacgcatggtgttggtgagttgaatatgcttggccatgccagcctcctatcgaatggtcttgcacttgaggacgacgacaccgccttcctcgactgcggtgctgacaccttcaccgtccgcagtaagggtgaggtggatctcgtcaccgacgtacttcgcgcggcctatcaccgccagggcgacaatgatgccgccccggtcacgctgcttgaccagcagatcgaacccgccgtctttgccttgaggaccagtagcgacatctgtcgccttgccgtctacggacagctcgatccagaaattacgaacgttcctcggcattgtgcgcttcctcgaagatgtagatcccggcgatgtacacgatcgcgccgagcagttcacgcttgcgcgcttcgtgttccatgccgcggctctcgttgagctttttcatagcctggaagtacataccgtcagaggtgcccatcaggccgctgatgatctgcgtggattgttcttcgaacgctgcttcactgccgtggcgttcgtgacctttaccgatcgaagcctgctgataggctgcgtgcagtacgtcccgcagcttgtcgtagccgggtacgtcgaaagtcgggacgacaggtttcgcagtagtgcgacgggtcatttggtttttcttcccatttggtacggagggtttcgagatccatggacgattcctccgcgactgcgttgcgcaggtattcttcccagg

SEQ ID NO: 5 - DNA, 43020 bp, Pseudomonas bacteriophage F95/13
cgttgtatcaagaacgccgcgatacacgttcgggaacgtaatttgaccgccgccgttgtcaacgaagcccacataaacgaacagttcgttattaatcagcaggaaggccgaaccgtcgcgcgcttggtctagcgtcgtgtattgctgcaaaccttcgatgcttgcttgcgacacgccggttacgacaaggcttccgcttgtatcgttgcgggtttcgctggcgactgtcgaagcgtaggcgttcagcaacacgccgccgccgttgtacggggcgctttcaagcgacagaataggcgacgaactgaaattgtccggggccgtcattgcgtcgtaagaaatggacgtagaacccggcgcaactgcggcaaggtacagacgcccggcagaatcaaacgaagccggggtttcgctgtcgtcgtatccggtaaggaacgcaggcggcgtaaaaataagccgcgttgtaaccggcgtcggttccgtactaattggcgtccatcctgaaccttcgggcggtgcgaacgtaagcgttgaagacgaaaagcggtcttgaacgcaagaaagcttgatttggttagacgtaagttcgccgaaatcaattttcgtaacacgcataaccatattcgaaatgccgaacggcgaccaattcagaacgaacacgcttccgggccgcaagttctgcgccttgcgattaacggtcaaatcgcacttgtaaagcggaacgttcaaaattgaaagctggcgcgctgcaatcttgcttgctaccgtcgcgtcggtaacgccgggcgtcgaaacttccgtagacttaacgcggttttgaaagttgatatttgcgaagtcttgggtaattgctacgctgtcgtcgtaactactggcgcggtttttgaacgtaacccggcattggttaaaagtgttttcccatgttgttttctggaagttgcgaagttccttaacggacgattcgtcaagaacaagaagttcggaaatcgtgtaatcttggcgaacaagtttcgcaacaatcttcgccgttgccgggtcttgatacaacacgccgtcggcgacgcgcattacttcttccaacaagtcttttccggtaatcgcagattgaacaataagcgacatacccaagccttcgttatacagcgtttgcgcgcaggccgtaaacgaaggcatatcaatttcgctttcaaggttgccgaagcggccccatttttgcgtcattgcgtcgtaaacaatttccatcgggttaacgtccaacccgtttggcatgattgaataagtcgcgtgcaagccggacgtaatgcgctgaatttcgaagctgaacggttccggcgtcgtacctgttccaatataaaaggctttgaacagcgcacgcgcaaagccgttgtaagccggaacattcgggccaatcttcgaaatcaagtaagaatcttgcggcgggtcaaaacgaccgtcgtaaaacgaaatcgtaccttgcaggccgccgcgttcgtcttcgccgccaaacaagttcggcttgttaatgtaaatgtcgccggacgaagttaagttgccttcccaaacaaggtaagtaccggcccaaaacttacgaagtcgaacgccggggccaaggcacaaaatgcaatcaatgccaagataatttttataaccgaccgtaactttcttcgaactaaaaagcccggtcttcattttcttacgaattggcaccgggcggaagtcgccaaaccaagccgttatcggcgatttctggcgcactgttccccacactagcggcatggggtcgccgtacttcgaacgcggaaattggaagtcgccaagtttcgcagcgcgtgcgttttcgacgttcggtttcggcataagcgccgccataagtaagaaggcgacgacgaagacaattgcaatccacattgttaatgaaccccgctttgaaatacgttattcgattcgcccggaacaaacgggcaaccgccgaagttcggttgattgttgaacttggggcaaccgttggccccgttgtaagaatggtcgcaacctgccgtaacctgaaccgaagtaccgacagaaatacgcgcgaattcgtaatttaccgttaaaattgccccggcttgcgcgacaatcattcgacgttcattgcgcgcaggtattgcgatttcgccgccgacaaaccaaccgtcgggaaaaccgccaagcgacggaatcgaaatattacgaccttcgaccgccgaaacctgcgtatctagcgaattgcttacgcggcttaccttgcaacgttcgtcgaacaaaacgttattgcaaggcggctgtacgtaaacgttcggtatattgcccgacagcatcgaaccgaacttgcttggcgttctgaacgttacaaattcgtcgtcaaccgaaattgaagcaatcggccctttccagtacgcaacccaagttgcagcgtcgcgctggcgacggtaaatcgtcaaaaccaaagacggcggcgtagtttgaaacgcatagtctttaacgatttgttccgtaatcggaagcgtaaccgtcatatctacgttgtcgtcttcgtgcgttccgacttttaacgtactgcgtttcaaacccggaacggggttatatgtcgcactgttgaagacgtgcgccagaacatcggaagtcatgtaataattgcgatacgaaccgacgaattcgtaaagttcaaatggtgcgctatcgcctacgctttcttctttgtcgtcgtaatcagacattagggttccgccgttcgaattgaaagattcaagattgattcaaggccgtaatgcttccattctactttatcgtcgccaaggcgtacaggcaacaagtacgaaattcgcttaacttccatccatccggccccggtcggaagcggcgtaccaagaagaagaattgtattgccagtttcaagcaaagttgcgcccaagatttcggttcgatgaatgcccgacgttgtttcaatttcgatataacgatgcgtgataatcggccaaatcttttcggcatactccgacccttcgacggtatagcttgaagtcgcgtcggacggttgcacggccaaggccaaatcggttcgatatgtgggcatccaaaacttgcgcgcctgtccgcgtgcatacgcaagaatcgctttccaataatccaattcttcgggattcaaaatacggtttactttgaagcttcgcggcccgccgatacggctataatcccaacggctaataatgtcggcaagtccggtttgattgtcgattgaaatttggccggttgaaacttcgtcgcgtacaaggtcgttcgcaagcgggcgcttcgtcaaaaccggcacgccgccgaactgttcaagtacgacggttgcgccgggtcgggtaagttgcgaacgctggcgaatcatcttcgcgttaatttctacttcgccgacggtatcgacggaataccgcgcaagtgccgtattgtcgtcaataagcgcaggcgaacccggaatgattaacgaccctgcgggaatgtcgaacagcaatggcgaaccaagcgtagccccgtcggctgtcaatacgtcaatttcgacaagcgcggcaacaagcggcgtttgaaccaaaacgtattcggtatcgcgaacgtcggtcttcgtccggtcgaaataaatttgaagcgcgccggtattacttgcggcagtaattcgggtcgcgtactgaaattcgggaatccaaagccgaccaactgccgacataacgtcgccgtaaaaacggcgcacggcttcgacagaatcgaaaattactttcaaccgttcttcaatgcgcggcatttcgccgcgaagtgctatgcgctgttctgttccgtcaaccgctacaatgttgtcgcttaaccattcccaagtttcgttcaatggaacttcgggcacaatgtcgaacttaaccgcgcgcgttcctgtaatcagaatcggcagcgggtcgggaacgttggaaaagtcaaattgaacttcgacgttaatattaggcggccccgaaacgcctacggttatttcgtaagtaagttcttgaagcggcggcattgcatacggcgtcgcttggcctgtaatttcaataccgaccggattacttaccaaaatgtcgtcaagatttgccgcacggtcgggccatgcgttccaaacgttgaattcgcgcgtttgtgacgacgcgaccgtttgcaagtccaagaccaacggcgaaacgtgaacgcgaaaataataatcgcgaaaaaagttgccttgttctttgcccacaataggccagcgattcgaaggcgcgattttgtacgccgaatatccgccgcgcaaaaacatatcgcgcgggtcgtaaatcgtcggcgcatattctgcggcggtaagttcgtttagttcggcggaaaggttagggttcgaatcgccgtaaacaaaatattgcgccgctaaaaatgttccaagtcttccggccattctttttaagttccagtgtatttaatggcgtatccaaacgttccgctatgcgtcgcgccgcttgaccaaccgacgccgtttcgaacggttgcgtcttttctcaaaaatgggtaaattttccattggtcggcaccgaacgtaataatttcgccgggaacaatgttgtcgattcttgtatatcgggcgttattcaaacttgcgactattgtttttccgctggaagttctaggctttacgcacttgattggaagcaaaatcgttgcttgattggacaagttcggaagtgcgttaatcaaagacgcgcaatattccggcccatgccttgcgcctgttgcagttgttgcgctgtatgcgtccaaccattcgacagaatccaagccgcaatgaatgaaggacgttgttaccgaaggcccgttgtcggcaaacaagccgcacatattcgccgtcgcaacatagccaccgaagccccaacttgtttcgcttgcgcccaaaaaagttttttgcccataacttcctgtatttgaagcggttgcacttgcgccgaagcatccggtaaaccaacaacctgtaccgcctatgcccggaatattcgatttaccgaacgaaagttgttggtaaaaatcagaattgtaattaataacgcaataaacttcgtccgggtcggtgaacaaatgtatttcgtaattgaccggaaacgaaatcgggtctacgttcggacttaccattttcgcttctttgtaagagccgtccggtacgccggtaagcgtcgaaccgctttggcctgtcccgcctgctatggaaagttcgccagcggttgcaacaagctttataaagcaagcatttttcgataaaatgccgcttgataaagtccagccgttagcagtgcaagcattttcaactgctgtttttacgtccgcaaatgttgcggctgttcctgtaatgtatgccattatttcatttccaatgcgacaaaatcgcgccaagaagtacggtttacgttttgcatcataacgaaagcccgcccgccgacagctttaatagcgtctacggcttgaagtacagtaagcccggtttggtcaacgaccgaacttccgccttcctgaactacgttttcgacgccgttgttaaagcctgaacagaaataaacgctatccaattcgccgaaaacgtttcgcggaattacgccgcttgacgcgctttcttgaagaataatcggttcgaattggtaataaatatcggcaggaaccaacgtgccggaaccctgcggcgcgcaaagtgcgttcgacgttgacgtgccgttgctgaacgggtaatggtaatactgttcccaattgcccgcctgattccgaagaaacaagaaagaagaagtcgccgaagtagtgccgttaacccttccgaaatatgggaaattgtgcgaagtatcagaaaaccgcttagcttccggcccgttgaacatagaagcaacaaccaaaggcgacgggtattcgccggggcgtgcatacggaaaaagcttgccgacgtaaaaatgttcataaaccggcgtaccgactttgaagcatccgacgattcgttgggcgttggccgttatgaaatacgtaatcgcgttattgtgggcagggcagccgctatattttccgcccggttgggtttcgaaactgtttccgcttacgtaaccgacgaaagttccgcaattgatattgtaataatcgccgccgacgctttggtaacacttgaaccctacaaagatttcttcaagaccggacaagccaacgcctttcaaaatcaattcgcggtcaagtccggttgacacgtaacgaagcgttgtccatccgttagcttcggccagcgttttgataattgccaaaacctgataatggcaatcgtcgccgccgcctttcgtaactgttccaattgcataacccatttatttaactccgacgatttttgcgacggtgccgccgttttgttcgatggtttccagaatgaaagcccggccttccgcagatttaagcccggccaaagccgcttctttcgattgtacgacaacggcgctaaaaggtacattgacaaccggcgcgggcgcgggttcggaattgccgcccctgcccacactagccgccattgcctgttcgtcgttgcgctgaacactggccgcgccagtttgcagggcttgaaggtcggcaacgccaatgcggttggttgccgatgcgttcataacgaattcttggccgtgtacgacgcccgcgacttcgtttacgcccattgacccggtaaaaccgcccgacttaaacccggtattctgcgaccggatttgctgaacgttcgccaagcctgcggcaattgcagccgcagccgcagccgcgcccaacgccgggccgacgtaaggaatcgacgccatcgcggcataagccgacgttgccgattgatacgtattaatcatcgcttgcgcgattgctgcggcctttccgaccgccgccattttcttatttcccgactgttgaagcgcggccaagtttccgaagaaactacttgccgaattcaagtacaggttttgccgctgcaattcaagttgcatacttgcggcggcgtattcttggtcgctaatcaaacgctgttcgttcagcattttaagctgttcgacgtaagtttgatattgggccaattgcgcgttaagctgcgtttgaaagttcgtcgtatcaatgcccatgccttgcaacatgctgttagttgcttcggcttggtcgcctgcgttgaaaccgcttccgctgttgttgcgcaagttctgaattgctttaagttggtcgataaactgttggcgcttgtttacgctggcgtccaacaacgacgcttcttgctgcgaaacggcgtttacttgctgaataagcaacagcttttcgcgaagctgcgccaattcggtttcgtttagaacgatgccctttgcaagcaaatcgttctgaacttgcataatctgctgttcgatttcgcgttgcttcggcagcatttgcaaaagctgcaattgctgttcaaggtcgcggttatactgccgcaacgggtcttgcgaatttgcgtaagcttccgacgccttcgttactgcgcgggcgtgctgttcctgcgtaattgcgcccatttgaagaagcttgttcgccgcttcctgcgccgcgttgtattccttcaacgggttaacagcttcggcgtaaattgcgtcgaactggcgttgaacttcggtcgcgtcttgaacggccttaatctttgccttgattgcttcggcttcttccgacgtaagcttaatctttttctgaatcaagctttcttcgatttggtcgaacttcgcttgcgcttcgcgctgcggttgaagctggaacatacgcgccaattcgttgtcaagctgcgtattgattttttccattgccagcgcgcgacgttccgcagccttcgccgcgtttgcgtcggtagacccggcaagctgcgacgcaccggccccgcgaagctgcgcgcttcctgcggccctgcgctgcgcgccgatttgctgcgaacggtcgaaaagcccgttcaacaggttttgcattgcgccgccttggctgttaaatccgtcttccagcgattgcgcccaaagcttgccccaagattcgaattcggtttggcctgcgctgcccatgcgttcgaattggacaagttcgtaagccgacttaccgaccatcgcgcgaagcctgttcgcggcttcaatggctttattcgttacgttttcaatccaacccgcaacaacgttgtaagcgtttgcgattccattttgaaccgaaataacaacttcggccattgcacggcctgcgaacgttgcggccccggtcaaaagcccggcgattgcgtcaagaacttttgcggcgttttccagcgcaccggcccaacctgtacggttggtttggaagaatgcggcgtagctgtccgaccaagaagaagtcgaatcgtcaacgttcgaagtaatttcgccaagggctgcgcttgcgaagtcgctaagttctgcccacaattgcgacgcgatggttttaacgtcgtcgattgcttggccgatgccttcaaaggtcgcgcggaagaaatcgcccaacgtcgtaacgtcgtcgattcctaagttaatttcgtcgcggaaaagcgcaaggtacgcaatcgcagccgaaagcgcgacgacgataaggccaatcgggttcgaagcaagcgccagcgtaaaggcttttaccgcagccgtcgcaccggccagcgcaccaaccaacggggcaccgaaggcaacaagcaacgcaacgccaagccctgcgacgattacggcaaccgtcttcaagttttcgccaagccaaataatcgcgcgcgaaagcccggcagtaaagccggtcgctttgttcaattcgccgaagaactgaattgcattgttgcgaagaacggtcaagctttggctaattgtgggcgtcgtcttgttaaacgttgcgtctacttggtcttgtataagcttgaaagcttcaaacaaaacttcggaagtaatcttaccttgggttgaaagttccttaacccggttaattggaacgttaagcgccttcgctactgcgtccaaaacgattggcatattttccgaaacggcgcggaattcgtcgccttgcaacttaccggcgttgaagccctgcgaaagctgcaacaaagccgacgacgcttcttgcgctgttgcaccggaaacaatcaaagccttgttaatggtttcggtcattcgcaacgaatcttcttgcgacttgcccataaacgccaaggcacggtcgaagcgtgtaaacgctgtcgccgtttcttcaatacccgcgcgcgtgcggttcgacagttcgaaaagttcgtttgtaagcgtgtttacttgttcttgcgacttcgttacgttctgcaacttgttttgaagcgtaacgtatgcgtcggcgcttgcaagaattgcgttcgccgaaatcgttacgccaagaattccggcagcggttcgaatgtatccgccaagggccgaagtcgcgttgcgggtcgaattggcggcccggtcttgcgcctgttgcagccgcagggcggcaagggcggcccggtcgttcgctgccgccgcgttggccgtctgaacggctgtccgctgctgttctgtcgctaggcgctgcgcggctgtcgccgtctgctgttgggccgtctgcgtgcgctgcgtggcgctggcaaggttggcttgcgcggttgccccttgggtcgcagccgtcgcgacgcgctgttgggcggctgcggcctgcgctgcggcgcttgcggtgcgctgctgttcggttgccagccgttgcgcggcaagcgcgccttgttgaagctggcgcgttgcgctggccgatgcgttgataagctgcgacaagccgccgacattgattgccgaaagctgcgtttgaaggttcttaactgcggcgtcggcgttgcgggcttcgctggcgattgtgcgaagcttcgtcgaaatggacggcgaaactttgtcttgaaccttaatttctatgttttcgtcggccatttcttctaatccttaatcttgaacttcttacgcattttgcgaccaatcaaaacggcgcgttcgacgaaccccgccggggcttgtgccgaataaccgtcgttcagcctgcggatatacggaaggttgttcgtaataaatatcgcttggccgggcttcttgtttcgtaaaacaagcttcgcagaattcaacgtttcagccgccgaagcgcgttgcgttgaaccctgcgaacccggaaaatgcggcttgatttgttgacccgacggactttctagcgttacaatccagttcgacaaagcttgcgaagtatctacgggcgttttgtaagccaagtcgcccacaatagccaaagcggtatcgacggcgttttgtgacgccgcttcgtctattgccttcgctttcttttccagcctatcggctaggtctagcaggctttttgccattcgatgccgccgctttctgtttatccgctagtttcttcaagtgttccgaatcaagctttcgcataaaataaaacaagtcttcggtttgttcttcgtcaaactcgaaagcccttgcgtaagccgcaatacttgtccaaggtatcggcgttaaaccgttgccgtgcgaccgttcgctatctaggtcgaagaaggcttgcaaatacaactgcaagcctacttcaagttctggcgcgttcgcgatgcgttcgggtaacggttgccccgcgcgcatcgcttgctttgctatcgcctgttcgtgtgggccaagttccaacaggtgcgccaaaacttcggttagttttttgcttcggcttccaaagcgttatcgcggaagttcgaagccaacttggcttcttcctgcaaacgttcgtaaacgtccggcagttcggaaagaagcgaaattgcggcgtctttcgaatacgcaatttccttgccgtcttcgccctgaacgttcttccagccgcgcaacacggtatcgacgaacacgcccataaacagcgattcggcgacttcgtttttcagcgtgccaagttcgacttgacggcgataaggacgggtcgccgcgtcaagcgcctttgaatacgccttgttcgatttgcccatgcgggaaataacgaaagtcggaacgctgccgtcgtcgttctgcgcttcgggaaattcgatttcgacgccttcgacttccttggtcgaattcgttttgaattgcttaaacagtccagacatttgatttactccgattgaatgaagaaagggccggtattacccggccctttgagtttaccgcaattagtccggcattgccagattcggcagataagaaaacacttcgtacagcatcgtatagccgttcgcgttttctgcgcctgcgggttccagcggaacggtaatcggcgcgtctttttcgacgttcagacgaccgccgcccaaaccaagcaacggaatatcgaacacgaaaccggcgttcttggccgcactgattaccgacaaaccaacgtcggcattcgcgcgaacagccttaaccgctgcgacggtcgtaaagtaagcggtaatcgaaccgccgacttcgaagttacccgccgaagtatcgaacgcgcccaacacgccgaccgccttgttcggcgtaacgttgttgttaatcgaaacgttcgcttcggaaacgtagccgaacagggcggcggggttcgacgacgcggcgtcgtgaacggccatcttgattcggtaaacgtccgaagaagtgttgtaagcatcttcgccgggcgcaggcacgcgggttccggctttctgttcgtcgccggggtcgccgctgcggtaagtgttgtcgcacgcaacaaacgaaaggtcggcgttcagcttgtcggcctgcggaatgttcaacgtaaattcgttcggtactgcgccttccagatattcgcactgtgtaccgttcaaaccttcgcccaaggtgcgttcgatttgatacgaacgacgcttgataagtgccggggtcttttcgttcttgataacagttccgacgaaaagacgaatcgacttgccggttccggtttcgttgacggcctgccaagttacgtcgtcgaaaacaagcgccttcgctgcaaccgacttaatgcgggcatagcccacattattagcgaagcggtttgccgtcgcatcgccgccgacgaagacccaacgaccggggaacagttcgggcatggtcgtaaagtcgccagcggtaacgataagcgaaacgacgttgccagttacggcaatgttcgcgtctgcggcggcaagctggcgaccgacgcattccagcttcgcgcctgcgggcggggtttcgtcaatcaaggtttcagcaacaacgacgcccgcagcggtagccgaaacgacggttttaaggccgttgttcgccgcgttggcaaagccggtcgcatataccagcatatcggcaccaaacacgccaagcccggaagctgcggcgtaagtgctgtcgattgcggtaacgccggtaagcgcgaccgatgcgccgttaagcggctgcgtcgaaggaagttcgcgcgcgtctgcgaagaagaagccttgcagaattcgcgcaaggtttgtcttcgtaaagtcggcgttgaagccgcccgatgcgtcaaggtcggtaatcgtgcctttcttgttctggcgcgacgggtcgataggcgcgcgggcaacggtcgaaagttcgccgccgaagtccgaatagctgttgggttccagtccgtaccaaacgggcgtcgtcggaagttgcttcaagcattcttcttcggcgaaggcaagtccggtaatgttgctgtcgattttggcaatttcgcataccatgttaagaactccttaacctatttcgtcgtattcaaattcggtaacgacgttaaaccgttcgtaaagttcttcgggcggaagttcgttaattcgcgtattgcgaaaccaaaccttacccggcgtcgatttcccgcgaaaagcattgcgggaaagtttcgccaatttctgcccaagttcgaacgcttgcgtattcgatttcgggcaaaagatttgtacgaagacaagacccgacgccgtgtattttctttgccccggtactccttcgcaggttgaaagggtcgcttgttcttcaaaaacggtttgcttcgacagccgaacccaaaacttcgaaccgtccggcaagtcgcgatattgcacgccctgccaacgaatttcgggaacataacccgcaattgccgcgcttcctgcgttccaagttgcaagaaaaagcgcgtttacttcgtcgttaacttggtcgaattcaatcatgcttgaaataccatcgtataaagtaccttttgcccgttcggcgaaagtacgtcgatataagccaagcgaagttcgaccccgttacgaattacaacgtctttcaaattcggggcaaacggaacattgcccataagccccattactgaacctttcggaacttcggtgcctttaatgaagttgaaagtttcttgcgtctgccggtcaactggcaaaaagcaaatggtaacgtctttgtcgtccggcaatgccgggccgggttcccaaggcttgttcgggtctgttggcgtagcgtcttcgataacgcgccatttgaccttttcgccattcttcgcgataagccgttgggccgtcttaattgcgcggtcgaattgtgccattcgtcaaacccttattgttcgaagcgcaaacttgttcgaagcgcattcgccaaacagcggcgcaagaagcgcgttcgctgcggtaaatgtgggcatgatgccaaccgacagcgggtcggcgtattccgtttcaatcggcccgaccttttcgcgcgtaacgtagtcttgcggcgaaacgttcggttgaaggtcgaagcctgcgttaatcgccatcgcaagctgaacttgcgcggcaataagcgacttcggaataacgttcgacggtacttcgtcttcgttaagaaagacgccagttcgcggccattgtaaagcctgcgtcgtcgaagttggcttgccttggaaccggcaagcctgcgcttctaaataatccgttgaacgaatcagcatggccgccaattcgtcgtcgtccaacggaagttcgacgccgcgattcgaagcgtaaatgcgcgcgtctgcgacgcttacgtaactgttcgcgtttgttacgccgcttccgtcttcaacaacgattgtaattgccatgcgtcaacgtccttacgaaagaacgatgccggttacaacgccgttcgcaacgctaacggttgcggtcgtcgtgtaagtgccagtaaccggaacggtcaaggcttcggcgtcgttaacgattgcttgcgttgccgtaagcgcctgattcgggattgcgtcggggtcgataacgtcaacttcggaataagccgaaggcgcagtacccgcgacgtaatccgacggaatgattcggtcggtttcgccgtattcggcatttgctgcgccgttggctaccaaaacttcgtattgcggttcggcggctgcgttaagcttcgcaatgtcggcaagttcgccagccgttgcgttaatgcctgccgtgaaataaacaacctttttcgttgccattgcgaagactccttagttcgttgttgaaacggcctgcccacaataagcgacaggccgtccgtttgttactgcgccgggttggggttccaagccggggcgctgccgccctgcggggccgctgccggggctttctggccctgcgccggggtctggccctgcgtagcggctgcgggcttgtcggcggccttgccgctggccttcggtgccggggcgtcgccgaccttcgaagtaagggctttcagttcggcggccttcttcttgattgcttcgcccgcttccgggtaagcatcggcgtacagcttcggaaccttgcccgctacgccgtcgcagatttccagcgaatgcggttcggacggaacagcgcgggcgttcctgaacataacttgcgcgttcagttcggcggcggctgcgaagtcttccggggtcggcgcgttgccgtcaacgaagaacagaatttttgccggtttcatcttcgaaactcctttgaatttgtgaaggactagaagaacggggccgaagccccgtccgtctgccgtcggttagttggtcttgacgacaacgcccgcaaggtctttatgcgaagttgcgtacttgtcccaattggtcgaagtgaacaacgccgcatcggtcggcgacttgccgccgtttgccttgtcccaagcgaagcccttaacgccgatgttgtacgaccattcggcttggtaagtccgaataatgttttcgtcgccgttcttggtttcttcgtttgcgtcgaagtcgttgttttgaccaatcagcacgccgcccggcacaaggccaagaatgtgataaacgttcggcgtacctgcggcaaacaggttcggcgaatcggtcataacaagaagcttgccgaacgggtcgcgaacaacgttcacggtgccgtaagtaaacaggcgttcgccgttggtcaagttcgaaccgtacagcttgtgcatgggcgtactgtgcataatccatgcggcaatctgcgacgattggtcgccgaacttggcttggccgttgttaaggttgttccaagtcggcagcttgtcggcggcatcggtgttcgcggtcgcgtcgtatacaacgtcggaaacctgcgacagtgccgaatagaccgaaccaagaccgacgttcagcatatccgccatcgtatcgacggcgagttgctgccccattgccgcgcctgcgacttccgggttctgctgaatccaacggaattggccggggtcaaggcgaacgggcggcgtaccggctgcgaccttaaccgacgtatcgacaaggtgtttcaagaccttttcggcgacggtgccggaaccgtaggcgttacgacggcgaacaaggccgcccgttaccttggcgaaaaaggcaacgtcggaaaagtcgccttggtgcgctgcggattgcagcatgatagccccgcccgtcgcagcgttgaacaaatcaacctgttggcgcagggtttcggagaaagccgaataagcgtattcggagtaaacagcaaggtcggaaagtgccatgattaagcgtccttagtttcgtttgccttcgcttctttaagatgcgccgcaagttctgcgggattcatcttcgaaaggtcggcgggtttgtcggattgaccgttaaatttcggggcaccgccgccgttctgcgaaggcttaccggcaccgccggacgccttactagccgtgataatagcagaaaaatccttgtttgcaacgaattcgtttgccagttcgtcgatagtaagggccgacggcttgccgtccttgtccagaacgcgcgtaaccggcgtgtcgccttcgaagtccgcgataagccgcgacttgatatgcggcatgatgattgccggggcgtttgaaatcttgtgggcaagctgcgaagcgacgttatcgacaagcgttttcgtcgtatgcgaagtaagcttggaaaccttggcttcgtattcttcgcgctgtttttcaagcttcgattgccaagacttttcaagcgtcgcaatgtcgcctttcttgcgcgcgtcgtcgccttcgatggattccagccgttcgcgaagttctttcgcttccttttcggcgtctttgcgcaactgcgcttcgcggtctttggcgcgcttcaaagcgcccgtatcttcgtcgccgtcaacgtcaaggcggaagccgtcgccgtcttcgatatattcggctttcagcgcgtccgaaagcttcgcgtgttcttctttggtaagtttctttttcagtgccatttcaaggactccttgcggttatgccgattcaccgaatcagcgggaaagaatttctttaatcttgcgtcggaattcttcgtaagttagcggcctgtccgcatcatacttcggaacgtccttcgcctttaagcgaccatcgcgcaaagcttcgccgccttcgttgcctaatatgtcgtcttgcacttgggcaggttgacgggcaacccaagtataaaacgtttcttcggccaagtcactagcggtatttgccggggcaacgtgcgaccgacaacggatatgcgcgggcggcaacggcccttcgccgaagcgatagattcggcgatttcgacttatgcaaatgtccgttgtccttccgtcgattaccgaataccaaacgtaacgaccgaaaaccgcagacataacgccagccgcaacgaccgccgcaacgtgcgcggttgccgtatggattaccgacgcggcttgcgcgttgacccggtgcaactgcgacggcgtgccctgcgctgcggttccatcgccgacaagcgccgttaaggtttcttcgaccgtccaacggttcgcccaagctttgcgaatcatgctttcgacgccagcttgtgccgaattcgtaaacgtcttgataaacggcagcaagtacaaaccatttgccggaattggcgtattcgtaacttgcgaccaaatacgttcgtcgcttcctgtaacagcggccaaaccgaacaaagggttcgaatcggcgttgggtacttctaaaagaaactgtatcgcttcttcgtccgaaataatgccgtcgctttcttcgccgtcaagttcgatataacccgtaacccatgcgcgccggtttacttccaagtcggcccgcatgaattcctttaactgttcaagtagcgtttgcgtatatgcgctgtaaatcttcgattgcgattcccgtaattccgaaacaagcttgtttaactgcgccttcgaaagaccgtcaagggtcttataacgaacacggccaagaaggcgcgttagttccaagtttacttcgcgaagtacgaacccgaattgtcgggactgccaaactttcacgtcttcgacgtaaacagcaaggcgcgtcgcaatatcgtacagtcgcttattgtccgatagtgccatgattgcgccccttattcagtgttgcccacattatcgccgccgctgccatcgcccggcacgttggccggggcagcaagggccattgcttcggcggtatccttggcgtattttttctttcgccttggcgtcgtcttcggttgcgacgccagctttacgcaagccggttcgcatttcttcgaaggtaattgcgcctttctgccattcttcaacaagcgaacggcgttcgtccggcgtcatgcgggcaatgtcgaaatctgtattcagttcgaacttaacgccgccgtcggcttgaccgacccaacgggccgcccatttcaacgcccattcaaaggccgccgaaacgttcttggttgcggtcgaaagcgtcgaaccttccgaagcggcttccaattcggcttcggttgccgtgcgctgtacttccttttgttcgacaagctttgcgccaagcgcgaccatttgccgttctttggcgtccattgcttctttaagcatggtgttcgggtcggcctgcaacaacttcgcatcggccccggcaggaagcggaataccgccgcgcgaaccgaagttaaccgaacctttaagaacgttcgtaacccattcttcggtaagtccgataagaacaggcgtcggctgtccgacaatataacaactttcttcgtaatccgccgaattgcgataatgcgccatattcagcgacgcaaggtcgtaaaagttcgggttgtccgggttcgaatcgttgttttccgaaccgatgaacataaacggaatttcggtaagtcgtttgccgcttgcatccgtcggcttgtaaacgacgtgttgttgataattgcccttcggaatcttcgacccgtcggctttggtcggctgcggttcgcgccaaatttcatggacgtaataaccttcttcgtccaaacgcaaaacgcggaattggcccgacgttttcatttcaaaaccatcatcggcagcgcaccaagtttcgaacagtacgaccaacgataaaacttcttccgcgccccggtcggtcgttcgccaattgataatttcagtcggcgaatatacgtacagggtcggacgaatgcgcccggcttcaaggtcggcaatcgacgcgccgccttcggcttcggttgtcgggtaatcgaccaacagtccggcgcgggaatacgcaaggttcagcgatacggcgcgctttgcaagctgcgtaaggttgatacccgaacccgtcgcgttcgcgacaagcgggttcaacagcgcgggcacctttacaaccgggtcgcgcatgaacacttgaccgaccaagccgaacagggttcgacgggctacgttatagaaaacggcccgcttcaagtaagcttcgtaacgcgccttattttctttcgattggtcttcggcgttcggcatcggaagataagtcgtccgcgcgccttttaccgttggttcgcccgcgattgcgtcgcgaatcaggtaatacagcggcagcagcttaccaagttcggggcgaataaatgaaacgttcggcatgatttgggttcctttaagttggcataacaagtttgaatttcgctgccgctttgttcgcgcctttcaatacgcgataacgcaccatatcgtaacaatggtcttcggcgttcgtgtctacgtcgtcaatcttcttttcgtcgcgcggcagtgtgggcagcaaatcaatacttgcaacgcaattcgacataaagtatatacccggcccttcgcgattaacagacgcttctaatcggtcgcggaaaagctgcaacccgattacgcgcgaacccggcgacttgtccgattcagtccagcgaacgcccttcttcgacataagcttttcggtcgtgtctagttcgctgtcgattacttggcgaatgcggttgtcggcagggccgggccaaggctgcgacaaaatccagccgttcgccattagcgaaatttcgcggtcgattatgccttgtgcgatattcgacgccgaaagcttcaaacctttattcggtatatattcgcccttttcgtctttcgcgcatccgtaccattcgaacaactgaataagcgaaccgggttgcgggcaaaacgtaaattcggtgccatccgaaagaactatagtcgcttcggttccgtccgcttccgcccaccagcccacactaaacggatgcgaagacccgtcgtcgtatgttctgtcgattcgccagcttggcggaatgacgaagcgcggtacaacgtgtatatgcgattgccaaaggtcgtcgattgcgccgcctgcggtaacgtcccaatcgccgtaaagccaagccttccgcaagttcggttctttgatactttccagttcggcgatatacgaagccggaaggtatgggttttccttatacgaaccgaagatagcgatttggctaattacgtgcgtttcttctttttcggtcgccgggttgtaaatctgaatttcgcgacgaactacggtgccgcgcggggcaatcgtgataaagcggcgctttacccaattgtgaccggggccgcttgggttcgtcgtactgaatacttcgcactttacaggcggcagcggttcgccgttctgcgtcaaatagcgcccggttttcgggtctttcggcgtgtcttttatcgggtcgaacgtacagcggttgaccgacataaatttgtcgtaaaggtcgccgcttggatgcttcgtaagttcgttccaaccgataaacgggtattcgtgaccgtggaagccttcgtaatccgacagcttcttaacgtgccgaaacaacagttcttcgccagtcggccaaacccatttataagccgacgttgattcgtaaaacttgccgccgtctttcagctttccgttatcgccgaaccattttttcgattcggcaacaaggccgcccaaatggtcaaattccaaatcgaagataacgccgcgccagaacttgccgtagcctttgccgacgttacgataaaagcgcataagctgcgtaagcgtcttgccggggccgcgtgcgccttcgtacagcgtatgcgctgccatcgaacaaagggcgatagtctgcgaccccggaaggggcttaaatacgacttcatacggaacaggtttcgccccgtttgtatcaatggcgagtgcgtgcattttctaacaattcgcgctgttgccgtgcggcttccgcttcccattcgctttcgttagcgaatacgggcatttcgacgacgcggtttacgttcgtcgttacgttaacgttcgtttgcggtttttcgatgaacccgcgaacgtcggcgtaaagcttggcaagcttcgcgtattcttcgggcgtcggcggaatggttacgccgttcggaagcgtcgtaccttgcatacgctgccaaatgtcgcgggcaaggtcgcttttgcccggaagaaatgccatatcgccgccttcgtcggtaaggcgcttttgttcggccttaacttcggcgtcgttcggccaatggttcgcaatccatagcgcgcgattcgtgttgttcggaaacagcgaaagcgcagccttaaacgggtcgcgttctttcaaaagaagggccgcgtatgcggccttttcttcgctttctttcagttcgtcggacatagtgtcggcctagtttatacgtcgttggcttcactataccgcaagccccgcgttctgttaaggcttgtccgcagatttaggcggcgactgcggcccgcaattgcgttcgacggcttcgttatggttcagaatttgccgggccgtgccagcggtcaagccgtcggccttcgaaatccaaatgggcgcaacccatttacaagccgtgtcgattacaacgggcttcgtttgtactgcgtcggcgatgctttgcggttcagtcgcgcgaccattcgtcgcgcagccgcttagtaacttcgtcgtcgtcaaaagtagaattatcggaagcaacttctttcgcattttgaaccgcctttacctgttgttcggaagcttcgcgggcttcgttaacttggcgaactgcgattgcttcgcggtcgtttgcccgttcgtttgctgcgttggcttcggccttggttgcgccggacttgcgaccggcataaaagatacttgccagcatgacaagacccgcgccgattgcggcaagccatttgccaaacttggcccaaattacggaaaacatacaatgcccctttacgcttcattcgtcgaaagttcgccgttcgacttcaacagcggcagcgaataacgttcttcaaacggaacgcttttaactgcggtcttgtttcgccagaacgacggccagaaatagccggttacgcgggatactgcgaacggtgcgatacttacggcgttcgactgattaccgccaagaaccataagatttccgcgcgcatccttgcccacaataaaaccgacgtggccgccgccgcttcgcgtgaaggtcacaagcgcgccgtatgcgggccggtcaagcttcgtaagctgcggggcttcccatgcccgcgccctgtaccattcgcggacgacgtagcgcccggcaacgcccaagcaatagccgacgaacagtccgcaccaaggcgtttcgtcgtcgtgccaccaagcgcgggattcgttggaaaattcgcccatgcggtcaagcatggcaagaagcttcgggttatgcgaagtcttcgaagtgtcttcgcgaaggccgatatactttcgggcttcggcaacccaaggaagttcgttattcatcggtcggccccttgtgcaatttcttttgcttgacaaggcgggcaacgatagaaagggcgaagacaacaacgccgataagcggcatatactgcggcggaatcgacgacttcaattcgtgcggaaggattgcccaagcggccaacgctgcgtcgggaaacgcaacaagaaggccagtaattgcggtgccgactgcggccagtcgaaccgaccaaaagcgccagaaatcgcgccaatcttcgataagttcgggcttcttcatttgtcggcctttttgtctattttgtcttcgatgcggtcaagctttgcgaatattgcggcaatgtcgcggttcatatcgtcgcgcttgacgtagtgcccggctacaagaacttcgatattgccgaccttatcggccaactttgaatcttgctgttgaagttctttaagcgactgccacataacgcgcatccaccaaccgcccaacgcgccaataattgcgacggctacgttaaaaaattgttgttcgttcattcacaagccccggccccgaaatctatttggccgaagattagcacggattagcacaaattgacaagaaacgcaaaagaaaaccccgacgcaatggccggggtttccgttgaagcgtaggcgtagggcgggccgtagcccgcgccgttgcttacttggtacgccagacgcgcgcgccgccttcgaccgaacgaacaacgaacttgcgggtttcgaccataacgggcacggtttcgcccttcttgttggtcttggtcgcgccgtcttcggacggaacagcgaaacgggcggttgcgctggaaacggtcgaagcaagcgacttcgcggcgttcggcttgtcttcgctgttcggaacgaagaagctttggccgacttccagcgcgtcgaacgggtaaacgttgccgccgcgaccgcgaccgctgccggtcggcatgggtacgttgtcttcgatggcgaaggaagtagcgaccggggcggaagctgcggcggtgccggtttcggtgttctggttcatttcgtcgattcctttttgggttgcgcgggttgcgatttcgcccgcttcgttggttactgccgggttgatttccaccataccggcttcgataagcgggccatgtacggcaggcgaagtatacaggccattcggcccggctgcaacaatttcggcaaggccgataaccggggcggcggtgttcttcttcgcggtcgatttcttggtagccattttgtgaaactccttaacgttaaggttatgtcgcgttgttgcgacgggttgattttacgccgaccgttcttcgtgtcaagcggtcaacgcaaaatttcttcgatttctgcgatgcgttcgggcgtgcattcagaatcgtaaattttgtcgtaatccggccaaacgccgttcgctacgttgtcacaatacaacaggtgcgcgcgggcttcgtcttcgaagtccatttgcccggccatgccaagcaacgcgacgaaggcgacgattccagcgataacaataagcttacggttcattgtgggcacctttgttcgtttcgatggttcaagcttacgaccgcttcgaacctttgtcaagtgaatttgcgacattttcgtaaccgacttgcgcgatacgttgggccataaggcaagcgttctgcgcttcgattaacgacgacaacagcttatcaagttcgcccgcctttggcaagcgttcgataacttcgatttgcgcttgaaggtaagcgtattgcatcgaaagggcttggtacattgtcggcgctgcggcaagcaagttatacaacgccgggtcaacggtaacacgcggcccgaatgcgacgaagcttccggcttggttgaacggttcggccttcggtgcgccgatatagttttgcgtcgttgggtcttggtagaacaacaacgcttcgatttgcgaatggtctagcggtttcatgttcgttaatccattgtaaacaggcattcgacgcccgcttggttaaagatgcgttcggcttcgtcggcagacgcgcgccagtctggcgatatatgcccacaataagcgacaacgcgacggataccggcccgaacgatgcggtcggcacaaatggcgcacggaaacagcggcgaaacgtacagcgtacacgcggacaagtcttcgcccggcgcagcctgtcgaattgcgttgtcttcggcatgaattacgaccgcgtgttgttcgtcgcgcgtcatgtttagaaaaacggcgtcgtcgaagccgcgcggcgggccgttgtacccaagcgacgcaatagaccgattcgggcgcacgatagccgcgccgatgcgcttacgcggccctttcgaccatccggcgacgtgttcggcaagttcaataaatcgcgcgtcccatttggacagggcttcgcgcggtacgtagattatcgacacttggcccgccttgctttttccagcgccgcgcgctgttcggcttcgcgcatacgttcggcgtattcgcgttgttcgaaccaatccagaatcggacgaatgaacgtgcgatgaatgaacaaagcggcaacggtgcaaagaagcaaaattagaacggtcatttcggcaactccttaacggggtttcttcgttacgtctaagtttcgtcgaaccttcgccgcttgtcaagcgttattcgtaacccggtataacttcgttcgggttgccgcctgcggccttgaagccttgacagtatcggaacgcctgtacggcgtccattgttccgccgcagttcgaacaagtgaacttttgcccgaacgtgtacggcgggtcgcctatttcgaaacgatggcgggcgcaaccgtcaatcttcgcccggttggccttgacagcttcgaacatttcgcgcgcttcgtccttattcatcttcggcaacccgcaacgacaaatcgcctttgataattacgacgccgtgccctacgtcttgcaccataaagccgcccgacacgtattcaaggtcgccgctgtccagcaagtcgccagcccttgccagcgcgtagcccatgcgggcgcgttcctgcggcgacagggcggtaacggtagccgaaggaaccggcacgtcgcgcccattggcccgcagcaaggccgcaagaaagaagccgacaacgacgccgacggaaagtacgccccaaccgataagccaagacattttcgttactccttcgttaataataatcgtaatccggttcgtaatccggttcgttgtcaacgtccgattgcgaatacgaatattcgcccggccccgcttcgtaaagcttgtcggcgattgcgtccaagccttttggaaggtctttataatcgacttcttcgccgtcgataaagtacgtcggttcgcccgcgtcgctttcttccgggtaacaatcttcgggcgggccgctaatgtaagcgggcgtatacgatacgccatattcgcacgacagaacgcgaccgtcggtcatttcgaattcggttgttacgttatatgcgggcatggtcgttactcctttgttcgttcaacttacgaagaagtgtacgacagcttcgaagctgcgtcaagcctttttcgcaagttgcagcaacgccgaagccgacgaccgtttgccgacgcatacgttacgcggcaccgattcgcggtacagcagccaataacccggcttcgttacgacgaaacagcgtttcgaacgcgcaatgctgcgggcttcgtctatcaattcttcgtcggtctttttcattgttcgccccttatcaagtgcggttgatacggcggcaacttcgacgcgcgatacagcttgccgccttcgacgtaataccgttcgccatagcaaacggacaaatgcccggcgatgcggtcaaggggccagcccacaagggccagcgccgccgctttcaaccgggcgcgggtaagttcgcaggcaaggcacgaaagccccattacgaaccccattcgatataggaacgaaggtacgacgccgcttgttcccaatcatagcagacgacccaaccatagccgacgcgctttgcgtattcgccgaatcttcgttgttcatccgatacgccgccttttgcggtttccgacttcggacgttcggtcggcttcttcatttcgatataaaggccgtgccaatcgccagacggccaaggcaagaacgtatcggctacgccctgccgcacgccttcggccttcaactgcgcgccgcgtatcttgcgggacttgtcgtcgtcgccgcgactgccgccgttcggtatggcgtggaaccattcaagggcgggcacggtcggcgtttcatacatactatacggcgtcgtttgcgggattacgccagtcttgcaccattcgtcggcaacgtcgaagccgtgcaagtatgcgaccgcgacataggcaaaaagcgccgtttggtgcgcgtgttcggtgccagacttggcaagggttgcgggcgtcatgcgatgccccttcggtcacgacagcgaccgcagctttcgacgacttcgcccgttcgcgggtcggtcacttcgacaacgcgcgcgaagtgttcgccgcaaaagtcgcattcgcccggatggcctgcgggtatcgctgcggcctttcggcaaagttcgccgaccgtaaagcttacttcgttttctattcggtcggctgtttggtctacttcgtccgccatgttctttcgttccccatgatagaaagaagccccgactatacaacagccggggcgctttggttagtgtttcgtcgcggccccgccttcgcgttcggccattacacgcgctacggcctgttctggcgtttcgccttcgcgcagttcaacgcggattgtttcgaccttgacgccgcgcccaagggcggccaacagcagggccaacagggcgtcgggcagttcgtcccggtcgttcagcaagtcggcggcgttctgcaagcgcgcgacgtgttccggctggaacgcttcggggttggcttcgtgtacttcctgcgcgacttccagaacatcgcccaaggcttcggccagcttttcgaccaagccaaggattttggcgcggtcttctttgtccgggccggaagcttcgacggcctgtttaatatcgcatacgatgcacattgttgtaactccttcaaaaatgccgggttgcgcccggcgcgctgttgattaggcgtcgaattcgtcaacttcggcagttgcgaccgggttttggcctttgcctgcgtaaacgttggcttgaatgcgaccgtcgcgccatgcaaaaactgaaacttcgaaaccgccgactttaacaatctgcgaagtaccgcgcagcatttcggcgcgggtttcaacgttgcgccaaacttggcggaaggcgtcaaaaattgcgttcattgcttggccttcggtaattgctgcggggcgcttgatttgtacgttttgcatttcggcggttccttgtgttcgttggtatgggtctatagtacgacgccttcgacgcttcgtcaatacctgcgaacaactttttttcagcctttacggtaacgaagttgtttcgtcatttcgcgcagccttgcgacgcttacgccgccgctactttcgacacgaataaaaccgctttcgctgtcatacgtgaacgacagcgggcgaacgccgtaaacggccttatatgcgtcggcgtagtcgttgaacgcctgttgaacggccttcggcacgcttccagccttgcggcgttgcttcggcactttatggccggtttcgatttcgtacatgcttcgccccttcttcaatgattacgacggcttgaaagcccgtccgggttggttggatggcaaaggcgttcggatactgcgcgcgaaggccaagatacgacgacccgaacacgcgaaccattttgcccacattgggccgcgcttcgctgttcatgctatccgcacgcattcgaaacagccgtattcagaatgccgaataaccgcaaacttcttgccggtcttcttgctgaactgcgacgcgccgtttcgcaacgatgcttcgttaccttcggccaacggcacggcgaacgactggccgattttcaacagcggccaaggatacttcgaacgttggtgcgtcaattcggcgtcaaagcctagcgcatcttcgaacgacttaattttgcttcgcgccttcggcgaacattcgattatttcgtaagacattgcaagcccctttcgttagtgcgtgccggaatcatagccttataaagtttgtatgtcaacaacgttataacacaaaaagcccgttatacgaattgaaggggctgtatagctgctaagtccttgataaataaagaaatataataaatttaataagtataataactaaaaatacaatctatataaagaaagcttaatttataacattgggccggggtttcagggtcaagggcattaaacgttatacttgttatgaatccggccaaagccttgatacgtaagggtttcagccttatataacgcccttatacgacccgtcggctattatacgcgaagacccttcgaaggattgggcgaaggttgttcaatgctgataacttcgaagctatcgaagaatgaagcaacgggcgaaacaaccaacgcaagcaacgcaacgcaggtaagggcgcgcattgttgcccggaatgcctttcgaaattcaccgttgcagaacaggtaataagcggcttcgaattgggaagcggccaagcgcgcaagggccaacccaagcgcgacgccaaatgcgataaaatatgcggtcattgttcttactccttttcgatacgttggcgggcttcttcgacccattgggaaacagtcaattcggaaagccgatacacgccgtaaacgccttgttctttggcgcaatctacggcggaacctgcgaagtaaaagtacccgcgacccttgaccaattccgcgtcgattccagcggcggcaagggctttgttcacggctgcaagggttgtacgcatggtcggtcgtccttcgcttaatgtgggcaggctgcgcggcccctagcgcgtgccaagggccggggccggggttagaagttccaaggctgcgcgttgcgttccttggcgaccctgcgggcttcggctttgccgcttacggcgattcgctggccttccgggcggttcgtttcgctgattacaacgaacttcgttttcttgctggcgaagtaatgggcgaacatttgtcgaactccttacgcggtgcgctgttgggctttcaggtaacgaacggccttcttggcgtctgcgacggcttgggcgcggctggcgcgcgtgtagctggcatgtacgacggtcggcgcgttatggtcgaagctgtacgcggtagcggtaaaggtgccgtcgtcgttcttcttgctgttccagcttacgacccgttgaatgttattaagtgcgttcatgttcgttagtccttcgttgtttgcttcgatggttcaaatatacggcaacttcgaagcttcgtcaataggtacgaaacaaaaaaaacgccccgaagggcgcttgcttagtcgaaccaagcccggtcgatttccggggctttgaaggccgaaagttcgtgcgcccaagtcataaccgaaaagccttcgaagttcgcgcccggatacttggcaacgattgcggcgattgcttcaacggaaattgcttctttcgccgattccaaaacgctttcgtcgaattggttggaaacgttaactttcttttcgccgttggcccaagcggccaattcgatttcaattttgatttcaacggcggttttaaggttggttacgttcatggcttcggttccttggtttggttcgttgcttcgatggtttgtattctacgtacagttcgaagctacgtcaacaggtacgacgaactttttttacaggcacgaaaaagccgcccgaaggcggcccgttctgcccacactggcgggcgcgcgttacaggccgaaaacgcccggatgcgcgaccatgtatgcaacggcgcttgttccgtaatccttcgccagtgtggcccggcttacttcctgcaaatcgccgcgttcgcaaagggtcttcaaggcgcgcttgattgccccgcttgcgccgatacggtctttacgaaagacggcaacagcggcaagcctgcgttgaacgtagctgtatggaacaattcggttcgaatgaaggttggacattccttcgcctgcgtacttcgcaacgtccggccaaggtgaaacgacgaaatctttaacggttgcaataaccttcgcaagttgtttcgtttcgtcgttgtctatgccaatttcgccagcatcgaaccgggcaagcaagtttcgaacgtcggcgacgacaaggttaatcgcccaagacgcaacgtcggcggtaatggtcgggtcgtaagggttgcagccaacggcgataattccggccagcttcaacgcctttacgtgcgcccggttccaaaggtgccgccgaacttcgcggtcgcttgtgttaatgttcgcgtcgcaatgcgcgtcgaattgctggaacagttcgcgggcggttgcgtcggtttgaacgtgaatcgccttatgttggctgttcagcattagcgcatgggcgcacaaggtcgaaagcctgtcgataagttcgaacgaaggttgggccgacaggtgccccggattcaacgccgggcgttcgccgtggtattcaatcatcgtaaaacgcggcaacagaccttcggaaatcaaaccttcgtgcaaaccttcgtaaaacttttcgggcgtcgattcgccaagcaaggtaaaagacggggccaatactgcggcggtgttcttgtccttgtctgaataaatcgaaggccgaagtaccttgccttcgcccgacttgttgtaagcatccaacaggaagcgacgaagcccggtaaggtgcggcggtgcgtttacgcttgccatttgttgaaggtaaatgccgaattcgccgaccaacgaaacgaacgacgttggcccgcgcgacatatacttgataatcgcttgcgacgaagcaatttcgccggggccgataaagtccgacgcggcgggaacggttcggataacctgcgccattagcttatcaatgccgcttgcgatggcttctttacctgttccggtcggtgccaacaacagaacgtattgattaaggccagtgccggaaatgttgtacgccctgcccacaataccggcgaccaaaccaagggcaccggccaacgcgatttcgggcaccgggcgcggcgcttgtgcgtaaatgtattgcgcgatttctccgactaatccgggcggcacgctatatacctttgaagcttcgttaaggttcggggccggggcttgcgtatgcggcgtcgcttcgctgttctgcgacaacgcggcggccctgtcggcggcttctttctttgctattgcttcgtctagcttgttgcgcaatccgtcaacgtcaacgggcggcaacatgcggtcgaaacacttgttcagcatgtacgaaacgtaatcgtcgcgttttgctttgtcacgctgccccaagccggacgcgcgaaacattcgcgaaatctgcgcccggttctgtgtataaaacgcgataatatcgaccaaggcaaagtcggcttcggattgcgaagcgtacatgccttcccatttgcccgcgtacagttcggcgaacttgtcgccattggctgcggcgactgcgcggttataaacctgttcgtcggtttccttggcttcggcaagcccggcgtaatgcgcgacggcgaccgaaccttgccccatttggccccaaagaacgtttaacagttcgttacaatcgttaatcggcgcgttgcggtaaatatcgccggtcattgtcatataacgaagcgaagaataaacttcgataaacgaacgacggcggcccgacggaatcgcgcccttgacgatgatatgcaaccccgaaccggaaggcgaccgttcggcgtagctgttgaattcgttaaaaatctttatttgacggtcaagcgccgtttggtcgcctttcgtgtcgtcaaggtcgataaaagaatacgggtcgttttcagtcaatacgaaaccgattccagcataccaaccggacgacatagcgttaacgcattcgtcgaacccggcccaagtgttcgggtcggttacgctggcaaggtgcccggtttttgctgaatacggaaccttcgtcggtttctttgaatccgtgtcttcgtatcgccaaacgacccattgcgggtaaatccgcatttcgtgcggaatgttgttaaagtccattctttgccaaccctttgtcaatcttgttataagtcgtcgccgttatgttcggcgcagaattggcaagcaaaagctttcttataagttcgtgcgaaacgtcgcattgcgcggccagtgcccgcagcgaccgcccgacgcttgctttctttacccgcttcgtaagttcttcaatgtccataacgccaccttctagcaattgtgggcagcttacccggcttcttgcttgctgtcaattgttgttgacaggaaaggcgcggtcggttacagtgctggaacgctggcgcatggtgcccggcccttctaaaaggtgaacgtatgaacgaacccgcaaagcccttcgactatatcgaagaagcgcacgttacggcgtccgacaagtattacggcgaccgcgtgccgctggcctacttccgcgaaaccatcgccgaagccgtcgaagcccttaacaagcttgacgcaatcaagaaagccatgttctacggccgcgacactggcgttccggccccggaagccaacgcggcaacgctggcgaagcttcccgcttggatttccgaccatcccgaacacgacgccgcagccgttaacgtcattcatgcaattatcggcaaagcgaccgaagcgggcgaactgttggaagccctaagcgccgcagccgaaggcgaagctttcgacgctgttaacgcgcttgaagaagtcggcgacggcttttggtacgatgcgcttttgctgcgcgccattggttcgaacttcggcgaagcgcagtcggtcaacatcgcgaagcttcgtcgtcgcttcccgaacgcctttaccgaattcgacgccaacaatcgcgacttgttcgaagaacgaaaaattcttgaaaaaggggcttgacagcaacgaagggccgtcgtatagttcgtacataccggcgcaattgtgcggcggcccaaccgaaggagtaacaacaatgtctttcaacgaaaacgctaaccgcgacgctttgattctgcaatggcaggaagcaacgaaggcgcttgccgcagcgaaagaagccgaatccgcattgcgcgccgaagttctgaaaaacgctttcggcttcaaccccgaagctttgcgcgaaggaaccgaaaacgtcgaacttggcgcaggctacaaactgaaagccgttttcaagattaaccgcagcttcgcaggcggccaagaagccgtcgaaaaggctttgcagaaaatcgaaaagaccggccccgaaggcgaatttatcgccgaacgtttggtaaaatggaagcccgaactttccgttaccgaatacaagaaccttcccgacaagttccgtaagcttatcgacgaagttgtaacgtcgaaggaagcaacgcccgcgcttgaacttgtcgcgccgaagtcgaagtaacaaccccgccccggttgcccacaagcgccggggccattcccgaaggtgcaagttatgcaaatgtcgcaattaaaaccggcgtcgcaactggcccgccgctacggcgtaaagtccgtcgtattcggtgcgcccggttccggcaaaacgccgcttatcaatactgcgccgcgtccggttttgcttgtgaccgaacccggtatgctgtccatgcgcggttcgaacgttcccgcatgggaagcgtattcgcccgcgcttatcgtcgaattcttcgaatggtttatgaaatcgcgcgaagctgcgaatttcgatacgttgggtattgacagtatttcgaacatcgccgaaattatcttggccgacgaattgggcaaggttaaacacggtatgaaggcttacggcaatatgtccgaacgtgtaatgaaaatcgcgaacgacttgtattacatgccgcaaaagcatatcgtaatgattgcgaaacaagcccttgtcgaaaacggacggcaaacgattttgcagaacggcgaagttacttacgaaccaattatgcaaaaacgcccgttctttccgggcaaagaccttaacgttaaagttccgcatttgttcgataacgttatgcacttgggcgaagcaagcgtacccggaatgccgaagccggttcgggcgctgcgaacgaaggaaattcccgaagttttcgcgcgcgaccgtttgggcaatcttaacgaacttgaacagcccgaccttaccgcattgttcgcgaaagcgatgcaataaaacggtttacttcgccgccgtaaccaatggcgaagacttttcgaaaaggtgaaacatcatgcaacttatccaagcgttcaacgcccaacagtacgacccgacccaaggcgtcggaagcctgccgattggcaagcatccggtaatcgtcgaatcttccgaagtcaaggccaacaaggcgaacgacggcggttatctgcaactgaacttgcggattatcgacggcccgcagcagggcacgaccggcgcttatcgcctgaacctgtaccattccaaccaacagaccgtcgaaatcgcgcatcgccagctttcggcaatctgccacgtaatcggcgtgttccaagttaccgattcgtcgcagcttcacaacctgccgtttcttatcgaagtcggcccgcagaaaaacgaacccgcagtataccgaagttaaaaaggtcttcgatatgaacgggaacgaaccgggcaaggctggcgcaggcgcaccggcagcgcagccgcagcaacagcagccgcagggcggcgcaggcttcggacagcagccgcagcagccgcaaggccagaacggcggggcttggggcgtcaaccgcagcagcagcccgcgcagcagcccgcaggcggtgccgcttggggcggacagcaacagcccgcgcagcaaccggcccaacagccgcagggcgcagcatggggcggccagcctgcccaacagcccgcccaacagcagcccgcgcagggcggcggctggcaacagggcggccagcccgcgcagggcggcgcaccggcaggcgcggcaccttggggccagcgttaaggcgtaacgccgtcgcggcgtagattcgccggggtcttaaccggccccggcgtttctttttaaggagtatgcgaacttatgtcgaaaataaaagacgcattgccgacgcccgaacaatgcgatacttgttgttccgttaacattgaactaacaacgaacgacaagatttacgggcgaacttatggcaattggccgcacatttattattgcaatgattgtcgcgccgccgttggttgccatccgggcacgtttattccgttgggtcgtatggccgacagaacaacgcgccagcttcgaacgaaagcccataacgaattcgaccgcctttggcaaaccggcttaatgtcgcgcgcgaaggcttacaattggcttgcgaaccaattaggaatcgacccgtcggattgccatatatcttggctgtcgaaagaccaacttaaagacgttgcgacactttcggcggattatctagcgaacaattacgaagcccttatgcggcgcaaggtgaagaacgatgcaaaacagcaaagacgcgaagaacgcacaattaacgctgaacgacgcgcagccgacgaaatccgacgcaggaaaacaaagcgtagaccttgacgcgcccggcgttgcaactgcccttgcgaagcgcattaaagaagatatagacgaatattgcgttcgcacgtatgacggcgggcaccgtcggcaccttggcgcgtcgttgattggcgacgaatgcaagcggaagctttggtatatcttccgttggtgttttcaggaaaagacggacggtcgcaagcaacgcttgtttaatcgtgggcaccgtgaagaagcccgctttatcgaatggctggaaggcatcggcgttcaatgttggtacgaaaaccgcgacggtttcttttaccaagccgaaagcgacagttacggcgtattgaaggaaggcgaagaactggcgttgggttgcgaccttattacgaacgaaaatccgtattacgcccaacacgtcgcacgcgcgaaagccgacggcttggaattcccacaataccgcatttccggcgttatggggcacttcggcgggtcgcttgacggcatcgcccggcttcccgaacgctacggtatcgacgaacccgttttgctggaattcaagaccaacggaacgggcaagggcttttcggacttaatgtcgcaaggaatggcagtaagcaagccgcagcatttcgcccaaacttcgacgtatggcaacgaatatcgttttcgttatgttctttacctgaacattaacaagaacgacgacgacttacattgcgaagttgtaaagctagaccatcggctaggccaacaaatgaaagaaaaggccgaacaaatcattctgtcgcaggaagcgccgccgcgcttgtcggataatccgacgtttcataagtgcggatattgcgcggcgaaggatatttgccacaagggcgcgattcctgaaaagaactgccgaagctgcaaggccgcaaaccctgtcgaaaacggcgaatggttttgcgaagttcataacgacgtaattccgggcgatttcatcgctacgggttgcgattcttattcaccaattacagcggtcgcaaagaatgtctaatatttatgttccgcgttggtatcaagacgaagcggaatattcaatattcgattatttccagcgcggcggggtcggaaaccccgtcgtcgctatgccgacgggaaccggaaagtcggtcgtaattgcaaactttattcgtcgaattttcggttactggccgaatcaacgaataatgatgcttacgcatgttaaagaactaatcgaacagaacgccgaaaagcttatgtcgatttggccgaccgcgccaatgggcatttattcggcgggcttgaattcccgcgatatgattatgccaatcgtattcggcggcgttcagtccgtagcgcctgcgattaaacgcgggcttgaagaagacgacggacgcccggcgcatcttcgccatttcggttggcgcgacttgctgttaatcgacgaatgccatttgttaagcgacaaggaagattcgcattaccaatacattatcgccgaacttcgcaagattaacccgcatcttaaagttatcggattcacggcaacgccctatcgaatgaaaatggggcttattaccgacaacggaatttttaccgacatttgttacgatataaccggcgttgaatcgtttaatcgacttatcgccgaaggctacttgtcgccgcttatcgcaaggccgacgcgaaccgaaatcgacttgtcgaaagtaggcgtaacggctggcgaattcaacagcaagcaactagaagccgccgtagataccgacgaagttgtttttaacgctgttcgggaaatgaccgaaatagcttacgaccgttcgacttggcttatcttcgcaactggcattgataataccgaacacgtcgcgaacgtaattcagtcttacggcttggaagttctgccggttcattccaagttgccttcgaagaccaataccgaacgtttgcgcgctttcaaagctggcgaacttcgcggcttggtatcggggcagaaacttacaacgggtttcgaccatccaccgattgactttatcggcgatttgaacccgacgctatcgccgggcaaacacgttcaaaagttgggacgcggaacccgaccgtcgccggataccggcaaacaaaattgtctgtacgcggacttcgccggaaacgttcgaaggcttggcccaatcaacgacccgcgaattccaaacagaccgggcaaaggcggcggcgacgcgcccgttcgtatttgcgacgtatgcggcgtatataatcacgctgcggcccggcagtgtatcaactgcggcaccgaatttacttttgaaacgaagttgtttgcgactgccggaacgctggaaccgctgcgaagcgacgcgccgatagtcgaatatttcgacgttcaaaaggtactttacaatttgcacgaaaagcgcgacgcaaacggaaacctaacaaagccgccgatgattaaagttagttacttttgcggcttccaaatgttcaacgaatttataatgcttgaacatccggggcttgcggcgaaacgttcgcgcgattggtggcggcagcggcacgccgaagaaccgccgccgacgacttatcaagctttgcagcgtgtttcagaacttcgcacgccgcgccgtgttcgcgtatgggtgaacaaaaagtatcccgaagttctttccgctgaatggtgaacaaatggccgaaacatcgcccgacaaaaacgtagaaaagaaccgcgaattactgttgcaacgttcaatcgttggacttgcaaagtatggcgtaacgacggacaataacccgttgccgcttcgcgattggttgcaacacgcgctagaagaaacgctagacttggcgaattatcttcaagcggcaatttcaaaacttgacgaagaaggggccgaaaatgaaaatcgacagtaatattccgcttccgcccgaagacgaagcgccagccgcagaaccgacaaagcgcaagccaagggcgcgaaagcaagccgcagccggaaagaacaaagccaaagggccaagccctgcggcgtcgcttttggcggcgttgaagttcgttgccattgcgcagaaaaaggccgggccgacgaacgttcagttcggccatattgcccacaattgggcggcagcttccgacggggttttgaccgtcgcgcatcctatcgaagaagacttggtagcgtgcccgcatacgttgcagtttatcgacgcgctgtcgaaggtcggcgaagaactgtcaattacgcagcttaccgcgaacgcccttgccgtatcgtctggcgcgttccgggcgttggtgccttgtgtgggcttcgacgacgtaccgattaccgcgcccgacccgcaatgcgccacaatcgacgaccggattaaaacggccttcgctgcggtcgcagggcttgcgacagacggcgcaccgaatgcgacctatgccgccgtcttgctgcaagccggaagcgccgtcgcgaccaacggggcggccttgctggaagcgtggcacggtatcgaccttccgcccggcatgatgcttccgaagtgcgcggcggtcgctgtcgccaaggctggcccggcccttaccggcttcggcttttcggcttcgtcggcaacgttctatttcgaaaacggggcgtttatcaaaacgcaactttacggcgaacgttacccgaattaccaagtcgtcttcgaagtcgaaggcttgaacccttggccggttcccgacgatttttacaacggcgttcgcgcgattcagtcgttcagcccgaacggaaacgtatttttcgacgacggggcggttttgtcgaagatgcacaaagaagaagcttcgacgtacaaaatcgaaggcttgccggaacgaatgggcttttctgcgaagttgcttctttccgtcgaacatgcgtttaagaaagcgcatttcgcaccggacgcaaacaaagtcgtatttttcggcgaaaacctgcgcggcgttcttatgggtcttgaccttggcagcgaagcgacgcataatccgtcggacaattacgaagacgatataccgttttaaggggcttccgcatgattaacgaacaaggctttattgttgcaaagaaaagccgcgtcgtcgataagctggccgcaagcattcgacaggctttgcggcctgtcgaatttatgtcggacgaagaactaacggcaatgcctgccggaagtgtcttcgtcttcgacgttgaaacttacgtaaatttcttttacgtagcgtttaagtcgcttgataacggaaagttcgtcgcattcgaacgcagccccgaccatgattttaacccgacgaagcttctttggatgctttggcggttctgtatcgtcggcttcaattcgcgcaattatgacttgccgatgattgaactagccgcacgcggcgcagattgcaagaagcttaaagaagcgtccgatttcatcattaaaagcgggccgaactatggaaccgaaaaggtaacgccgttcgcgttcgaaaagaagtacggcgtacaaattggccgatacaatcatatcgaccttatcgaagttgcgccgcttcaaggttcgttgaagctgtacgcagggcgcttgcattgcgaacgtatgcaagacttgccatttcccgaagaccatgtattaacgcaggaagacgccgaaatagtgcggccttattgctgcaacgacctttcgaataccgaacttttgtttaacgaacttgcgcccgaattgaaattgcgggccgaaatgtcggaagaatacggcgtagaccttcggtctaaatcagacgcacaagtagccgaagcggttattaactccgaacttcaaaaagtccttggctattatccgaagaagcccacactatccgccgatacggtcttggtttacgaagtacccgactttgtttgctatcagacgacgcagcttcgcgaaatgctggaagtagtgcgaaacgcccgcttctatcttgacggcttggggtcgccaatcatgccgcccgaactggaaaagctgaaagtaaccatcggcggttcgacgtacaaactaggcatgggcggtttgcattctaccgaaaagaaaacggcgcactatgcgaccgacgaaataattttggcagacaacgacgtagaatcgttttacccgcgaacaatccttaatcaaagactttgcccgccgcacttgggcgaagcgttcttgaccgtttacgaaaaaatcgtaaatacccgaattcacgccaaagccgaagcggcgaaggcaaagaaggcgggcgaccgcgcagccgcgaagaaatggaagaccgttgccgacagcttgaagattaccattaacggaagcttcggcaagcttggcaacaagtattcgacgctttacgcgccgcaacttatgttgcaagtaacgattaccgggcaacttgtgttgcttatgcttatcgaagctttggaacaaatcggcattgaagttatttccggtaataccgacggcattatttcgaagtatcacaaatcgcgacacgacgaagtaagggcgcttattgcgtcttgggaagaatggacaggatacaagaccgaagaaacgcggtataaagccgtattcagccgcgacgttaatagttatgtcgcaatcaaggaagacggcggcgaccccgaagcgcgctttattgacgaacaattgggcgcaaaaacgaagggcgcttattgcgaacgcgggtcggccttgaattcgattctttcgaagaaccccgaaaccctgatttgttccgacgctgttgttcgcttccttgttgacggaacgccggtcgaaaagacgattaaggaatgccgcgacttccggcgcttcgttgcagtaaagaacgtgcgcggcggcggcgaaaagaacggtcgttatcttggcaaggttgttcgttggtattacccgaagaacgaagccgggtatattgcttacgtatccagcggaaacaaagtcgggaaaaccgacggcgcacgccctgtaatggacttgccgacggaatttcccgacgatataaattacgattggtacattaacgaagcggtcgaaatgctgtacgactgcgggcggttgaagaaggccaaaaccgccgcgctgtcgttcttttgattacggcggcggcggtgccgttagggtcattgtaagcgaatcgctgtacgttgaatatttcgaattcgacgtaataaacgaatctacaataacttctaacgtaccgtacttgcccgttacgtcaagggtcgttgaacttccggcagtcgtaacggtcgtgtaaccgccgccgcctacgcgccagcgaacgcgggtttcggtgccagcttcccgcgtgttcgccgtgtcgccatacacgcgcaacagggtatcggcccggctgcggttgcgccatgcaacagcaatcgacgttgcgcctacttgtgggcttggcgtgcggcttcctgcaagcgttaggtactgcggcggcagcggcaacccggcccggttggtaagcgacccgctgaacgacggggccaacgaaatatcaagcttgccgcccgaagtcgtatccaaaagcttaacgtatcgtgtcgttccgaccgaaacaagttccggcaacagtccgtcggttccgctaatgaaccaaacgcggtcgttcgccgcatgattgcccgg

SEQ ID NO: 6 - DNA, 113073 bp, Klebsiella bacteriophage F391/08
attatgcaaactaaacgaaatcatacactccactaattaaaggttgacaacatgaaacgctttgtaatatcatctaaaccggcggcaaaattgaacaaaatggcaagctcggaactggtcaaaatgcagcgcgatatggcgcggcgttaccgctcttatcagcgcggaggtcagcaaggcttaccgatgatttgggataacatgatgcgttatctaaaatctttacaaaataacgtttgacaatctgccgataacgctttattatagaatctcaataagcaacaccgctctttaaaaatttggaaaagtcgattctctcagtaagggtaattgagttttctgttaacactctagcagtaaaagagtgttaaccggataacccaataaactaaactggagtaagaaacatgcaaaacgttaaaaccccaatgatcggtgattccgtttttattcctttcgttactggcgacgtaagtaagccgggcgaaaatgaaaaaatcggatatatcaaaggggcggcgatgatcccgtttgataaaattaatgcggtatacgccgaaacggaaaaagcaaaaaacagcgacgcgaagatttacagcgtccgggtagattccggcgacgtggtgaaagtcattcgcaaagatgataaatggttggctgtcgcttaacagccaataagtttaaccccggcaaataatgggatgcttcccctatgttagacttccgatgtatattccatgcagcgcaagcaatgttatggtgcgcaaattaaacttatgtgctggaacttatatcatgctttgaacggcaattgtgagttaacacgaatctatagcgtgaaatagacgtaatagcgtaattattaaaggcagcgtatatatacaatgccgctttaaatagctttaaattgaaaactaaaataaagagttttcgttatatattctagctagaatatatagcggctaactttctagccttaacccttaaataaaactggagatatatcatgactgctactaaaaccgaaaaattcgcatggaacgaaacaaacgccgctaccgccgttgaaatgtacgaaaagatcattgcttccgatggtctggaggtggctaactcgcaaggtcttattgatattgcaaaggctgtaggtgctgaatcgcatgttaaagtgcgctctaaactggttagcgcaaaggtgtatcagaagtccgataagccgcgcaaagtcggcggcggctcctccctgcgtaaagctcactatgtgcgcgttctcactcagcacgccattgctgacggcctgattgatgatgccgatggtctggcaagtctggaacaaatgaagctcgaccaactggacgttatcgcccgtatggttggcgttcaggatgaagtaaaagaatcagcagaataattataatgcgcctccctagcggggcgcataattaaatattttgtcccccataactggagaaataaaaatggctttaattaaaggctccgttattaaattaacgggaaccgttgtggatgaattaatccaaacggggtatcaggataataaggttatgacgcccccaagcgttaaagtacctgaatatattgttttgtgggttaaccctgatgcggatactttcgggatggctattaaccgcgaagtctttaagccggaaatgctggaattatcttcccgcgaaatttaccttctcaattacgctttcagcgtagaagaaaaggaggttgtaaaatgatctttttccctactgaatccttaattcttatcgctggctttttcgccgccgcttgtctctatggttactataatttcatggaaataggcagcgaacaaacggatttattacgccgtgacttctggttcaagaaagcgagtatttgccgccgctggtcaataatctttattattctagcggtaactttcggaatatcagcaagcattatcccggcaatagtttagagtcgcaaattataacgccaccagcaacaaggcgttatatttggcaattctgcctatatcccattaactggagaatttagataatgatcattgcaattgagaaacaaaaagctattttaaccgctgctaacaacctcaatttttggggtaaacgcctgcgcgctaaaaagctggagatctgcgacgaattgagcaaagagcattacgggacggcgaaacactctagcgaaatttgcgattggctggatagtaacaagcctgttaaacccgctgctgaaaaacgcgcccaacgtgttgcggtggaagattcccgccccgttgccgctggtcagcttaattccagcgtcgaaagctggaaggtaattccgggccgccgttttctgctaacgtcgattcaaaataataccttccctcatgctaatttctggaaaactttacaggaggccgcgaaatatctcggcgctactctgttagtaagcaaatacgcctacaacaaaaaaggcttccaaaacgggcaaggcaacgatgaactgaaatatgatgatgctttctcagatttcatttgtgatgaaaacgtgtttttgggcaaccgcgaaaccggattcgcattcatggcggaaattaatattctgccaactgctgattttccgctgtccggctttggcgagactgcgaccgcctacggcctgaaagggctggctattggtcacgctaaaatcaccgccgaaagtgtcccggcaatgaagggcgacactgtgcgccgtatgtattcaactggcacagcgacgctgaaaaattatattcagcaaaaagcgggccaaaaggccgaagcgctgcataactatggcgctttgctggtagagatcgacgacaacggcaacttctttgctcgccaaatcgaaacgatggacgaaagcgggatgttttacgatcttaatcataaatttactgttaacggtggcgaggaggtaacgggccacgttgccgcgctgcaatatggtgacattcacgccgaaaagctggatcacgctgtcgcctttgcttcatgggggccgtgtgatgattctctagtgaacgtcctgcgccctcgttaccagattgtgcatgatgtgcatgactttacatcacgaaaccatcataaccgcgctagtggcgttttccttgcgaaacaatatgccgccggacgtgacaaggtaattgacgatcttatcgataccgggcgcgtactagaagcaatggaacgtgaattcagtcaaacggtcattgttgaatcgaaccacgatcttgcgctttctcgctggctggatgatagtaaagctaacattcaacaagacccggcgaacgcccatctttattatcgcctgaatgctgcgatttatgaagcaatcgaaaacaaggacgatacttttaacgtactagattacgccctgcgcaatgttgctggctgcgattttgctgcgatcttcttaaccacggatgaatctatgaaaattgcgggcatcgaatgcggttcccacggtcacaacggcattaacggcgctcgcggcaacccgaagggattccgcaagctcggcaagatgaacactggccatacgcatacgcccagcatttacggcggcgtttataccgctggcgtcgctggttccctcgatatgggttacaacatcggcgcgtctagctggtcacaaacgcatttgatcacctatgaaaacgggcaacgtaccttgattgactttaaagacggcgttttctttgcataacaaaaaagccggggtaattgccccggcaataaataacccataaataaataaataagctggagaaacaaatgaaacttactttcatctataacaatcgtaaatctttcaccgcgtccaacgtcgtagaaaatagccttgttatttcccgcgatagtgaagggcgcccgcatgttagctatcagaaagttaacacggtggacggcgacactgttttaaaagctctagccgctatcctcccgcgccccgctgaatttaaagaatccggcattgtgtcgcaattagtcgccgccgattctattctttatgaggctgatatctgcgagatcgtagagattgacgccgccgccgctggccttatgtttatcgtcgtaagcgaaaatgattatgatgatacctatctgctcggcgacgtgatggattattcttctagcgaatatacgccgccgctggcaattgtcccggtaatggctacccggattaaaccggctgaattagccgatgccttaactttattcttctgataattaacaaagcgagttataatatagctcgcttgattaattaccaacaaccccgaaaccggagaaatgaaaaatggcttttaataaactggcaattaaggcaattaagttatgggatttagacggaactgttattaattcctttgcccgcgtgttcccgtgtatggatgataaagggaacttagatttaaacatgtaccgggaaaaggcttgcgtacatgatgcaattatgaccgacactcttttaccgctggttgaatatatgcgggcatcgcttaacgatcccactgtattaaacattattgtcaccgctcgttatatgggtaagagtgactactatttcctacgcaaacaacgtatccgggcggggcgcggtggtaatatccagatactgtcccgcgatgtattgcaccgatatattggcgatgctgattataaagaggtgtactattcgaaagatggtatctataaaacgcattatttcgaaatgcttaaagctgaatatccgaacgctactatcactatgattgacgataatagaggcgtgttggctgctgctgctgctgctggccttcaaacgatggacgctaccgcaattaacgatattctatctattggtgtgcgccttgcgggtgagtcattcatagatgaagcgctggatgatgataatgattatcaatatctttgcgagcgtttagctcattgctgggaaggtatgaccgaagaagaaagaagcgactacggaattaagccgcaacaatttattcaatcgttagccatcgcatcataagaaagctaatagtaccctagcgaaatagttagggtactaatagttagctaggggggtaatcggactaccataccaccccccgaccctctaagcccacctccatgtgtaactttatgaaatttggagaaaaggctaaagggagtacttaggcaaacttagaacgagcagcccgaatcaaagctactactgctactgccgctgtcgcaataagaacttcccgagtcatacccgctatacgttgcaactgccgcagttgtagctatgattgctgcagtcgacccatcatcgctccgagaacttcccgagttcgatgaaggacttcccgaaactttccgagaattatccgagcctgcccgtttttgcttgcgtttcgcgacctgtggtgtcactggagggatgtagtacgggttgctcgggtcattccgaagatcgttcatgactcgttggtgttttgagatcgctacttgacgttctgcccgagtttgaaggatctcttgatgcagacttttgttacgaagatctgccgctactaccgcgttccgcaggtcatgtgcccgcacaccaaaccaaactgctgccaggaaaaagaatgttgtgaaaattaatacaatagtcatgttttacaccatacccttagtaatgtagattttgtttgctgattctagttctgccttgcattcagacaggtttaactgtgccttatgcagcaaacgggtttgattgtcataagacttctgcagcaccccgttagtgcgttctagctgtttgattgccttaccctgctttacggtaatgacgaatagtacgattgagagtaaaacaagtgctcctataactacttccatagtggtcctcctagatggttttaaaaaatctggtttacttggcggttgatttaatttataataatattatattataaaagtcacttgttagcaagtgagattttgaggtttttatgggcttttatgcaggaaggataggcgacaaaaaagtgttgtctcttacctctggcaacaataaagacgttaataaccacactaatccaggttgggatactatattccatagcgatatgcctcacgttgtagttttagaaactcacgaaagagacctctgggatggtggtgattggtatcgttgtactagaatgccagacagaattattcaggtactgtccgcagactacgacagggttgtcttaactgaagttgagtttgaggatggcaccagacgtttcatttatggtacatccctgggtgtgggcgctaaagcgtataacgcttactttagtaatactgtcggttcccaggcttctgcaggtactatggctagtatgaagactaacgtttgtgcttctgcagacttacacatggatattagtttctatttcgaagagacgccaggtactattaacgagaagctacgagacggtactgggtgtatgtacacctggggcgttaactcagaatggggagacagagggcctgggccgccggttggagctcctatacgtcctaactttgagactattattaaagctggatgggtgctctataggggggcttttagtggcaatatagccggttctgtgtctccgcccaatagaccccttactattggtgttgatgctatgcgccacccgtggatgcgtactactggtgttaacagtatatgtttgcgtggtgagactctcaaccgtaatatgtacggacatatggggcctagatatgggcagagctccaatcccgttggtggtccttatgctcataacatccagactgagtcttatcaggaggttcagtacaaagcaggttttttccgtggtccgcccaataactttatggggtgggaaaacacagataacaacaatgctggtagtggttggggtaacaatgccatttaccgtgacaataacttccgtgttcctaaacgtgttcgctggtatattactaatatgaaatacaatgggcaggggttctacgcagagaacgtatttggctcccgcaaccaggagattaaaatcagccctagagagttcattgtaaacggtataaacctaatgaacactgggtggaagttcataaaccagaacgatataaactacagcccaggtaataggcctgatatccgagttattgcaaccaacgtcgccagatttagtggcaaccctactgttggtaataatggatatgttcactttaatcagcctctaactcgaccagataatggtgctgagtttggacaaggtaacgtgagtgagatgcatgtaaccactgtaggggtttacaattttagatctgatgcacagtggtacgtaaaatctaacccgccggaaatcggaaaccagtggggtccagtatggtctgaatcaactcgacctctccgcctagtgggcggtaccggctctgctgatattggagggaacctacgtactagcggtaatgctagtcaccacctggctaccttgtggttaggggttaataactcccgaaatggggcttgcgtcgtcactctagactggaaaaatgatgagtggattgctgctgcagggattggatgttataaccctctagaagatcttacccagtggagcgaggtggatagtaggctgagaattttcggaaatcacttccagaaacgtgtgcatcaaatcatgtgtttgcccgttaacatgtgtgtgccgttccactttatacgcgggaccgtaacccagtgtggggttattcctgggaacaacgccatgcaaatgaaggctatgtgggcacctactactaccaactctgccactcagggcgattatgccattatctattggctgatagctagggctgacggtagtgttgaagtttgggttaacgttgagatgagcaatatcatgaatatgcgagtaattcttcctgaggttaggattgctgtgcaaaggcttgcctaaaggaggcaatatgagcaatgatttaattgtaccagatacaatgtctccggaaggcatgctagttatagaggcctacctggagtctggcagcgacgttgcgaaagcagcgttagctgttggcatggaggaacctaaattccgggagattatgcgtaaacctgaggtcaaagcgtaccttacggatatcttcatggaatctggcttccgtaaccgtgataaattcttcggcattctagacactgttctaactatgaaaatggaggaactggatgaaactggaatgggttcagagatggatattatggatatcctcaaactcatgcacaaaatgaagatggatgagatgaagatgcagatcgagtatgagaaggtgaagcaagctaaagctccaatacaccaaaataatactcagatcaacctggcagggggtcacgactctaattacacggaccttctgtcacgcattgtgggagcaggtaagtaatggaaatctcacgtagttatattaatacgactgacgtggtggattttggtgttgataaacgattctttaaattcccggtgtccggcttgctggccaccgaggggatcgttccaaatggcccgcagtgcgcaatcataaacgcactggaagacccacgtcaccgtttcgttacagcatgcgtatcacgtcgtgttggcaagtcgttcattgcgtatactctaggcttccttaaactcctagagccgaacgttaaggtgctcgtagtagctccgaactactccctggcaaacatcgggtgggcgcagatcaaaggtctgattaagaaatacgggcttcaaactgagcgtgagaacgccaaagataaagagattgaacttgctaacggttcgctctttaagctggcttctgctgcgcaggctgactccgcagttggtcgttcatacgactttattatctttgacgaagcagcgatctccgacgttggtggggacgcttttgatattcagctccgtcctacactagacaaacctaactctaaagctctgtttatctctactcctcgtggcggtaactggttcaagcgcttctatgaacagggattcagagaggatcttccgcaatgggtatcaatccacggtacataccgagataaccctcgcgtatctcttgcagatatcgaggaagcacgtaagactgtatctaagaactacttcaaacaggagtatgaggcggacttctccgtattcgaaggtcagatttacgacaccttcagcgtttccgagcacgtacaggatcttgcaggtatggggcacttctttgctgcggaccatgagttcgaaaccattctaggtatcgacgttggttacagagacccgacagcagtacttaccattaagtaccactatgaccaagatgtgtactacatccttgaggagtaccagcaggcagagaagactacagcacagcatgccatgtacatacaacactgcatagaccggtataacgtagaccgtatcttcgttgactccgcggctgcacagttccgacaggacttagcatacgagcatgaaatatcctctgctcctgccaaaaaatctgttctagatggcctggcatgcctagctgctctattccagcagggtaagatcattgtcgacgcctcgtgcactgcgttaattcacgcactccagaactacaagtgggacttccaagaaggggaggaaaagctctccagagagaaacctcgtcacgatgccaactctcacttatgtgacgcactgcgttacggcatctactcgatttcccgtggcaaataagagctgagttggaacggatagtagtgagtacaaattccgttccaactttataaaattcactttacaatttcgtgtgtggcagttataatatattcataccttgagagatctcatagacatcagggtgaatgagaggaatatttaattgctatacccgaagtagtattttcccaactaagaggaggaacactttggcttccaatgtaaaatataagagagatgcaatctccataatgcgtgacggaatcaaagcccagtacaaaagaggcaactgttgcgccatttgtgactcacaggaaaacctggagctacaccactactcgactgtggccttactagttaaaaactttgctaaagaattccaactggatttcactgactcagaagtcgtcctaagtaatcgggataagttctataaacattattggcatgagctagtagaggacacggtcaccttatgtgtctttcatcatcagaccttacacaaggtctatacgaaagaacctccgttgttttcagctaacaaacagaagatttgggttgagaaacaacgtgaaagatgtatgaatccagaggcacctcgtacaagcaacactggcgaaagatcaggctttgcgaagtggcttccgactgacgtcaagactgagaaatcaggattcgcaaggttcctataatggctattcgtgactggttagttactaaactaaaccgcggacaacgcataatcagggacttggaggatgttagtcaccgtactaacgtcaagccattcacgactggcaaagcctattcgtctattgagatccttaatagatccgcgaacatggtaattgacagcgccgctgagtgctcctacaccgtaggtgaacagtataaaacaataacaacctatggcacgatcaggagtaaaactcttgagacgctgcttaatgttcgccctaacccgtacatggattccagtacttttagacgcctaatagtgtctgaccttctattcgaagggtgcgcgtatatccattgggacggttcgtctctgtaccatctgcctgctgccctaatggaagtaaaagcagatgacaaaaaattcgttaacaaattcgtctttaataatatgatcgactatcgcgttgatgaaattatcttcatcaaagataatggccagaatggtggtattaactcccagattacgggtcaatctcgtgtggctaccgtaattaactcgcttactaagcgtgagaaaatgcttgagttcaaggagaaattcctggacaatggtacggttatcggtcttattctagaaacagatgaaatcctaaataaaaagctccgtgaacgtaaacaagaagagcttcagctggactataaccctagtaccggccaatcaactgtgctcattctagacggcgggatgaaggctaagccatactcccaaatctcctcctttaaagatctcgatttcgagaacgatatcgctcgttttaataaagacgtatgtatcgctctcggagtcccacaactattgatcgatgggggtaacaacgccaatattcgaccgaacattgagctgttctactacatgactattgtgcctatgctcaataaagtatgtagctctcttacgttcttcttcggttttaaagtaacgcccaatactaaagacgtagtagcactaactcctgacaaggagaaagaggctaaattcgtaactgcactggtcaacaacggtatccttaccggtaacgaaggtcgtatagagcttggttacgaggagctggctgacgagcagatgaagaaaattcgcatccctgccaacgtagctggatcagctaccggagtaagtggacaagaaggtggcgctcccaataaagacgaggaaaaacaatgattgactataaagcattaaaagcactattccctaatggtctccccgaggcacataacgtgtttgcaaccgttaaggcacatctcacttaccagattctgcgtaaggagtatgggtacgctgctactaacagtaaaacctgggatcagtttaaggaagcctacgcggaagcaactaagccagtaccggtagcttctgttagtatcacgggcgctcctgcatccttagactatactaagactgtacagcttgccgcaactgtcctaccaacaaacgcagataataaaactgtaacgtggaagactagtgatgctaccctagctactgtgagctcaacaggattagtaacagccctgtctaaggcaggcactgttaaaattactgccactgcaggtggtaaatctagtgaagtgtctattcaggtcaaggctcctgttgtagcagttaccggtgtcactatgtcacctaagactattacaatcgaagcaggtaagaccggcaaacttactggtaccgtagccccggctaacgcaaccaataagtctgtaacttacacttctgctgataccaccaaagctaccgtagctgcggacggtacggtaactgttcctgctaacctggctgcggatagtaccgtagttattactgttaaaacagctgacggcaataagaccgacactgcaatagtaacagttaaggttcctacagcgggtgtgtaatatctgttaactggggagcttcggctccccatttttctatgctagtgcataactattttcagtgtaaccaatttcgactacctactaattccacacaccgtgtgggattttcaaatatcttttgacattcgcgatttggtatgtaataatagtatctgaaaactgaggaacaacacgaaagtgtttggagcaaacgatgcagaatattaatcttaatgctgagattaaatctgttaaagctgtcggtgagggtgataatcctcctttaaaaatcaaagggtatgctaacacgattaccaaagaccgcgccggcgacgttattctctccgaagcgtggactaccagtaacgccctcaagaattttatgaagaacccgatcatgcttttcggccataaccatagccgcccaattggtaagatcctagacctggtaccaaccgagtccggacttatggttgagggtgaggtaagtgctgctgatctacagatttactcattaatacgtgatgaggttcttaaaacgttctcggtaggcttctatattaaagacgccgaatgggacgatatgactgaaacgttcattattaaagatctggagttactcgagatctctgtagtctcggttccctgcaaccaagactcaacttttagcctttcgaagtctgtaaaccataatgattacatggagcttcgtaagtcttttgtaaaatcttcgcaggtccagcctgttgaacaacctgaactttctaatttagagaaattcctagtagccgctggttacgctaaaggataatggagaaataataatgtcttacgatatcgcacaactgtctaaagatctgggcctgggtgacattgctgagcagcttaaaggtctaaccgcctctcagaaagctgaagaagctcgcaaatttgctgctgagcaggaagctaaagaactcaagcgtatggaagacctggttgctaaagcaactggtgaagaccgtaaaaacctggcagaagctctggagcttgtaaaaaacctggatgagaaatccaaacagtccgctgaagcgttcgttaaagcaatgaactcccagcaggaagaaatcactggtctgaaagaagaaatcaaatctctgctggccgctcgtgaaaatggtcgctctttcgtagctgatggcgttgctaaggcaatgtttggtaagcaggaagatttcgaagacgaagttgagaaactggttcttctgtcctacgtaatgcagaaagatgtattcggtactaagcgtggcgaagcccacctgaaagctgttaacggctcttcttctatcgaagtttctaccgaagcatacgaaaccatcttctccctgcgtatcctgcgtgacattcaggctaaactgattatcggtaccatgttcgaagaactgccgatgtctagcaaattgctgaccatgatggttgagccggaagctggtgaagctagctgggttgacgcctctacttacggtactcctgctactgttggtgcggaagacaaaaccaagctgtctgaaatcaccttcaagacctacaaactggctgctaaagcgtatatgaccgacgaaacagaagaagatgctatcttcactctgctgccgatcatgcgtcgtcgtctgattgaagctcacgctatcgcaatcgaaaaggcgttcctgaccggtactggtgctgcgggtactccgaaaggcctgatccagttcgctaaagacgatggtaaagtggttgctaccactgctaaagctgacggttctgttaaagttaccgctaaagaaattcacaagctgcgtcgttcgctgggccgccacggtctagacctgaacaaactggctctggttgtttcgatggatgcttactacgatctgatcgaagacgaagaattccaggacgttgcacaggttaccgctaccaccgctatcaaactgcagggtcaggttggtcgtatctacggtctgccggtactggtttctgagttcttcccagctaaggctgcaagcgctgagttctgtgtagttgtttaccgtgacaacttcatcgttcctcgtcagcgtgcaatcactgttgagaaagagcgtcaggctgaacgtcagcgcgatgcgtactacgttactcagcgtctgaacctgatgcgtttcttcgagaacggcgtagttgctggtgcttacgctgcttaatttggctatactgccgactaaaggagagcttcggctctccttttttattgggtaaaatatgcaattcatgacagattctgattggagaacatatggaggccttaaacgtcctgacttagagtcaaatatcccaatgttaatcaaagcagccaatgctctgattactcagcttctaggtattgacgacactgctaacgttgtagacgttctgcctactaaaccagcacgcaaaaagtacttcctgtcttctcccgtgcctagcacgatcactaaaattacgattaacgatcaggagatcgataagtcgcaatataagaactacccggatggtacgctcttgctgaaattctcccctccagaggggtatatggaagtagagtttactcagaccggcttcacctcgatccctgacgacctggtactagcagcctgcttcctagttgatcactgggtcaagaaggactaccgcgagtctcgtacattcggcggagaaaccgttactttcaataccactaaatctggcgtaccggaacacattcgtactataatcgaagtataccggaggctgtagtggcgttgggcgatctagctcgacagatagttaaagaacagctggacattatgagtggtggtagccactctaccaagaacaccgtgatatatagtgcggaaactatggataaccacaaagatggcaccataggcaaggtatccttccgatttaccaagccggtatcggaggatttactgaatgttcggacgtcctctattttaaaagctgtctcgtcgtcacttaatctggaaggtgacgttggtgttatcgataaccttctaaatagtatcactggtaaaaaatccaaaataggaagaaaacggtctaccggtagggtagaggttaactttggagatccttcagatgctgacaacggttacgctggtgctatttctggcgcttctgggcgtttcgtctcaaacacaaaccttagagcgttacttgaactcgtagcgaaagaatacttagtcaaggatatgaaaaaagctggggcaccccttaaatttagaacggggcgtttcgctaattccttgaagattaaagacgtgctgttaagagaagacgcaggggcaaagactcctgacctcaacatcacgtataactacatgcttaagccttactctgtgttcaaccctgccgtctctacctaccgcggactttccttacggcctttccctggtgctaggaacccgcagaagctgatcggcgaggcaatcgctaaggctgcaagagaccttatccattctagataccggataagagtaaatcagggtacataatgaattacagaacaagtattgctgatgccctagtggaacgactgaagaaggacatggatgggagtaatcccacagagttcttcactaatatgtatgggaacgtatcccgccagacttattcgtttgagcagatcaatgagttcccttacatagcagtccatgtgggtaccgaaactggaaactacctgccgtctgcacagcagtgggtttaccttgaaattcctattcttatctatgataaagaaaaggatgatattaacatgcaacttgagaaactcatagcggatgtaaaaacctctattgacactggaggaaatttacaatatactataatgaaacctgatggttcaactatcgattctgaagccactgacatgcagatcacgtcggtgtccacagacgagggtatactgtccccgtttggttttgctcaagttaacgtaacagtccggtatatgcctctgagaagagcgctggatagataagttacagctcaggagaaatttaaatgtctgtacaactattacgtaatacacgaatcttcgtgtcaaccgttactacggggttcactaaggccaacactcaggagatcctagttcaggatgatgtctcctggagccaggacagtaactccactgatattaccctaaatgaggctggccctaagccgacccgcggttcgcagcgctttaacgattcattgaacgctgctgagtggagcttctccacttatatcctaccgtatgacgatgcaggtaaacagatcctgccggactacctactgtggcacggactggcaactggagctgccgtgaatctagcaggtactactggcgtattccagaatgctactaacctggttgtcaactttaaagacaacgggtaccacgaactggccatgttgaacatctacatcctaaccgatagctcttggtctgtgatccgtaactgccaggttgggcaggctgaggttaacgtagatattgatgatatcgggcgtgtaacctggtcaggtaatggtactcgcttggagaccctagcttctcagccgttcgaccctaaaaccatagggatagacgacgctctttatgctaagattcagagttcttatatcaagaacaaactgaccattcttaagctgaagaacaacgctaccggcggaaaaacctataacatcccgatcacgggaggttctttcactatgaacaacaacgtgacgtacctgactcctaacatcatgtctcgtgttgacgttccgatcggttcattcactggttccttcgagctgactggttccttgacagcgtatatgaatgatgctgccaacggctctatccagctgtacaaagatctggtttccgacctgaaagctgtgaacgacttcgaagttgcaatcatcctgggtggagagtatgatactgctcgtccggcagctgttctggtggctaagcacgctaacctgaacatcccgtcaatcgaaactgatgacgtgctgggtgtgtctattgagttcaaggctattccgactcagatggacgcaggggatgaaggttatctgggcttctcttccaagtacaccaagacttcgatcgcgaagctgatcagctctggtgacggtaaccctgtcacaccataaggataactaatgctatactccctaatgcgggagtctagagtagtcatcgagtacgatggcagggcgtacggatttgacgccctgtctgattacactgctggaacgtcctacgaagagtttaaagcaaatcgtaggacgattcacagacgcagtaactacgcctattcgaagataactgctcagtctccttcttcaatttctctaactcttaacttctctagcaatgctctcgaaggtctatttttcgagttgatggggtttatagagatagacggaatgtatcagatgcccttgttcagtaataatattgagcctaaaatgttctccgtatatattattaacaagaacacgagcttacgtttcgataactgttttgctaccacctgcgacttttctctagataagagtgtcccggtgctaaacgttggtatcgagtcgggatactttgaggaagtaggccacccactcaacagctatacgcttgatcaaggtgaggtgctaccattttcattacctcaggtatcttcgaatgggagagtgctcccaggacttatgtcagccggtatgtcattccagcagcaatgcgaatggcgaggtgacagaagtttattcgatatcaataagatttataataatagaagggcaatcgttaacgaattgaactcatccgctttgatatcgatgtactatgcaaagagtcttcagatagactctacgcataacattaaacctgatattggcctaccggtacaaatcagaaataaatatattgtggtggatttcccttccactcgaatcacaaaacgcctagacttaaccgacgtgtacaagatcgattatgacgtaatacctactgagcaatcagatcctgtccgaatcaagctaattggagaataacaaatgagtattaacctaaaagatattgcactggataccaaacagatcaccattgcataccctggcctaccacacttcaaactgaaagttaactacgtctcccgtaagctctccaagaaaattctggaagctgcacaagagaaccagtttgttaatggtatcgctgttaaagtgcaaaacgatgacaaattcgcagaagagttcgtcaaagtggctattgcaggttgggaaggtctgaccgtcgcagatgttgagaaactaatgctgatcgaagttccagaagatcgtctggaagacaaagtcgaatttagtatcgacaacgcgatgatgttggtgcgtaactccagtgccttcgagacttggatgaacagcactgtcttccacctagacacttttcgtggctcaaaatcggaacctactgcttaaggaaatagatgcctttgcagaacgatgtgtcaaaggaggggactccaaaattacacgggagcagtatctgacgatgtgcgaatccctcggggaggaacctaaccccgaggtacttaaacgtttcgtagagatccatgacttccctgaaatcgcacagaccgctctaacaatatataacaacttatcggataactatatccccggagattatccaacctatttaggcaaggataagagtgctttactagttttcttcgatatctacggagtcgaagacgctgatgagaagagccttatactccaaatcatcaatatattcgactcacatgccgtggcagcctctcgtaaacgcgttgaagcagctattaagaagtctaaaatgaagtcttctagtaggtagtgagttacagtttcctccaacgggcgttccacgtgaggcttggcctagggttaatgccctaggcctttttattggaaaaaatcatgacagatagactaatacgagaattacttgtagatatcaagcagcgtggtggatccaaagccgctaaacaaatcagggatgttgaagctgctttagacggggctgctcagagctcagagggtctaaatacaagcttgggcaaacttcctgggtctttcacggcgctggaacgatctgtatcacgtactgctaagtcgctggagaaattatcctcgaccaccagcattacagcattagcagcgtctatcggcatgctaagcggcaagtttacctcgttcgaggttgacttggctaaatccgtactaaaaatcaacgcaaacctaaacggggtgacttccgccgctaacaaaatggcctctggttttgacactgcagccacttcttcggttgcggacttaaaccgcgtcaataaggctcttcaggagttagatgcgcacgcctcttcagtagctaaagtgttgcagaccttgaaggcgggggccgggttagaatctattagctctagtgctgctaaggctagtacggatcttagccacctagtatctggggtggaaaagataggtaaccaattagctagaatggcggagcaagccgtgctggcaggcaggtctcttcaggggctgaaagccgactccttaggggctgccggagagcatctgagtaaggctgcgtccgggatttccgtagctgtatcttctatgggcgaagaggtgaacaagctaaacaaactacttcttgagttggcagtaaaggctgatttagcgagtaaatctatagcaaatattgcaccagggaccaaactgaatagtctgggaactgaaatccagaagattaatactagtttagccactgcagccaatacctcggtagctgagatatctaagattaaagcagcccttacgtctttagtatcctctaccgctacagctgccgcttcaatgaaaaccgtaggaaccggtagtggtctgagcaagctaatctcagagatatcagcagccacctcagcttccacttcggatatctctaaagtaacagccgctttaaaacagcttaacgtagatgctacggcagcaggaaaagcactgcaaagtattaaagcaggcgcaaatctttcttctgtacctacagttgttggaaagataggtacttcaatgacgcagttgcgtgctcagttagaaggatctgtaaccggtatcgagaaaagcctaaatgatctatctagagcttttgccactatgggaggtacgggaaacctgaatccactgggtaactccatcagaggtatgatcccgtcactcacccagctggctaaggccgctgtgcaagttaactccgctctgtcaaaaatacaggcaggcaggggcgtacttcaattacctacccaattcaaagcagtaacggcctcattaaatgccctggagactaaactggcctctacgtctcaaatactagagcgcggattctccaagggatttcaggatatggcgtctaaatcaacctcgtcatctacgagaatgattaacaacttccagaaagtggtaccggagctcaacgctattgaagctgctgctatacgttctgctgctgcaatagacaagctaatagccaaacgtatacgcctcggacaagctgggggagggggtaaccctgcagcgttcaatatgggtgccttagtagcggaaatgaacaggattgtaacctccattgaagctatgggcaacaaaatgaataccaccatggctgatatggcacggagtacggacaaggtatctgacaaattaacagatctaaactcgggagttcgggatgttaatactggtttaggtgggttgaattcaacgttaacgggtacgggtagcgctgctaatagggcgtccagagcgttgggaaatacttcaggatctgctcgcggagctactaggaacttcgcagcactagctatggtgactggccctatgcctcttatctacggtgctatagcctctaacgtatacgtgcttaaagcagcgttcgatcagctaaaacttggagaccagctgaaccgcttagaacagtttggatctatcgtaggagcgaagacaggtacacctattcagtcccttgctgtggcactgcaggaagctaccggccacgcggtatcctttgaagaggcaatgcgtcaggcatctactgcggccgcgtatggtttcgacgctaaacagattagcgagtttgctctagttgcacgtagggcagcggctactcttggcgttgatatgaccgatgcactcaaccgtgtaatcaagggtgtgtccaagcaggaaattgagcttctagacgaattaggtgtaaccatccgtttaaatgatgcgtatgccgaatacgttaaaatacttaatgcggctaacactggtataacgtataacattcagggtctaacttccttccagaagcagcaggcatatgctaatgcggtagtagcagagtctaccaaacgcttcggctaccttgatgaggtactacgagcaaccccatgggagcaatttgcggctaatgcggattctgcattacgcaaggttcaacaagcagctgctaaatatctaggtccagttattgcatctataaacgcagcattctatacgtctaaggcttcggtatctgcagaggcagctactgcccagcaagagtcgattaagcaaatggacggtaaagactctaacgcagtggtcatgaaccttgaggcttctcagaaaggcttggatgatgcagtcaaagcaaaagaggaagtaaaaaataaactcgcagctcttaataaggagataatggatagagaggcgaagatggatatgtccactgcactggccacagccgccaactatagtgggttcggtaatctgcttaccctgggagcctctaaagctaacaaagaatttacacaacagactgcagatatgcgtagacaggcgtatatgttacagcaggagttagcagattctgcgggagctatccaaaaatggaaagacgccagggactccgctctatctaaggctcagaaagagaacccagaactggcggggaaacttaatatagggcagaacgttgaagcaagtaatggactatacacctttgacaacgcagcattagacggggcagttgctctacggaaggagttcaataatataaagaaaacttccggagatctgagcaacgatatccagaactttgcacaggactctaacactgcgtctcgagctactgcagcactgggtgatgcacttaaggcggttgagtcattggcgggtggatctacggaaaaagccaatcaaatgaccaaggaccttaatttgggctattccaccgtaaccgagatgaacactgcgtataaagccatgtctaactatcagaagatagtgaatgatgaggctaagtctaagctagatgttgagaaacgtatagcggaggtctacgctgccactcgtaataaggataaggcggaagaagctggtagagccctagaaatgcagcaacttagcgcgaagaaagaggcattgaaagctgtgctggcgacgaacaaggacaacaaggctattcaaaaagagttgaccctgttagagacggaagagctcaaagtgaagaaccagggcatggaagcgactaagaaggagaaattctataaggataagatagtaggcatagatcgagaaatagcactcctaaataatcgcactatgacagattctcagtataacgtggcgaaccttaaattaaatctacaagtagagaaagataggttagccttactgaagactcaggcagataaggagaaggaagccgaacagtctagacgtaacattgcctctattgaaagggaaatctggaaagagcagcttgaccgtaatgccaaaactgctgagatgcgtaaagaagaattcgagcgcaatcaaagcatgaagcctctaatgggagagtcacagaaaatgcaggagcagctagcgttctaccaagaaatgaaggaattcacgaaaggtaacgctgatgaacaggcgcgttggagcaaggaaattgctaacactactgcgcaaatggcggctctcaaagctcagcgtactgcacagatgatggatcgcgtaggacagtccttgggcgcagactatacgcctactactggcctggagggggaggataagaaattcgccgacatggaaaaccagatggcgtcatacgataccgctatcggtaagctctctcagctaaattcggaggctactgctactgctcaaagtatggggaacttagctaacgctatgatccagttctctcaaggatctctggatactacgtccatgattgcagcgggcatgcagacagttagccagatgatcagctacggtactaaccagcagatttcagcaattgatgcagctatagcggcagagcagaagcgtgacggtaaatctgagcagtctaagaacaagatcaaaaagatggaagcggagaagattaaacttcagcaggaatctgctaagaagcaaatcattatccagacagcagtagcggtaatgcaggcagcaacagctgttccgtatccgttctctattcctctgatgatcgcggctgggcttgcaggtgctctgtctctagcacaggcgtctagtgctaccggaatgaccgatatagcaggatctggtggtgaaaccgcctcttacctaaccttaggtgagcgccagaaaaacgtagacgttagcatgggcgcaaacgcaggtgaactatcttacgttcgcggcgataaaggcataggtagtgctaacggatttatccctcgtgcagaaggtggtaatacctacccaggtgtctcctataagatgggtgaacacggaacggaagttgcaactcctatggtgcctaccaaggtaactccagcggataaagtggcttctgaaacttcttctggcggtgctagaagaccggttaatctgaacatccaggcaatggacgctaagagctttatggagtacgcattggaaaaccctgcggcattccaggcagctgtagagttagccttgaatgaacaagggctgagcttaaagaacctgaattaactaaactaaagggaggacgtaattgtcctcccttctttttggaatttataaaattatcttgaaaatttttcttgatatgactataatattaacattgagaggagaaaacaaaacatgagattaccagatccctttacacatcctcagtataacggccttgggtttgataaagctacgctgatcgataatgatccagtgatcagagacgagctaccaaacggcaaggttaacgaagttaaaacagccactcagtactggggtcttaacattagttatcctgtgatgtttcccgacgagtatgctgtactttcgtcagcaattctagagtataagcgtaccagaggctatctcgacgttatactcccacattacgagtcttaccgagtaagaggggatgcgaacaactgtcgcattgccgctggacaaaaaggctccacactggttatcaccaatacgaattccttatctggagaacctaagccaggtgatttattccagttaaccacacatccaaaggtgtataagattacatcttttaaaaacgtagcaggagtatggacacttaatctataccctgatctgttgctcactaccaacggctccgagagaccacgtttcaatgggattcttttccaaactaaattaatgaacggagattcattcagcgaagagatcacagttgatggtgtatacgacggggttaacctagttctgagagaaagtctatgagacagatccttccttctgcgaaagcctaccttgccaacaatgacaagatacgattagcgtatcttgtctctatcgaactcccggggtccacgggtaataacgctgtttatgcttatatgacggactatatgagagatatcaactatggtggtatactcttccaatcagggaaaattaaaacaattagcagccacaaacaaaaccgtacgttaaccgtcggcagtttgagctttagtgttactggtacggatgccaacgaagtcattaagctcgtgcaaagtggtgtatcatttttagatcgctctatttctatatatcaggcgatcatcgacgacaatggggaaatccttccagtggacccagatactaatggccccttactcttctttaggggtaagattgtaggtggtggtatcaaagaaagtaatacagtatccggagttggtacttctgttataacctggaactgttctaatgaattctatgattttgagcgggttgctggacgcttcacagatgacgcttcccaccgaggacttgagattgtaaatggagaattactgccttctcacggtgccaaacgaccggaataccaagaagactatggattcttccacgccaacaagagcgttaacttcctagctaaatatcaagtaaaagaagaacgatacaagctagaatctaagaagaaattattcggtctctccaagagctacagccttaaaaagtattatgagactgttactaaagaagtagacctggacttcaaccttgcagccaaatttattcctgtagtatacggtactcaaaaagttcctggtatcccggttttcgcggatacagagagaaacaatccaaacgttgtgtacgtggtttacgcgttctgtgagggtgagattgaaggattcctagacttccagtttggggacgcccccatgatctgtactgatcaaactgacagtacatctcgtacatgctttggacaaaaaagggtgtcgggagatactatggcaagaatttccacagggctcccatcaacatctctctccacgcatggtcaagaatacaagtataatgacggtaacggagatatacgaatctggacattccatggcaagccagaccaaacggtagctacggtactaagagacattgctgctgctaacaatttcttccttcaaggagagaacggtaatggtccggagtactgggattctaggtacaagttattagacaccgcatacgctgtcatacgtttcactatcacggagaacagaactgatattcctgaagtatccgcagaattaagcggacgcaaagtgaaagtataccaggcagatggttctgttaaaatggataaaacgagtcagaatggtgtgtggcaaacatttgactacctaacctccaccacctttggtgcaagtatcccgatagacagaatggtgattggtgactggagaaaagaggccgatctattaaacattatagacacctcttatcaaactagttggcaacctttctggagatacgttggatgggagagctggacagccgaaaacagacaaataatgcaaatgaacacaatcctggataactccaactctgtgttcaaaaacgtgcaggagctattagaatccttccagggggcgttgaataacctatcaggtatcttccgcatcaccgtagagaaagattcaaaaactccgctagaacttaatttcctagatacttatggggacctggatctatcagatactacaggccgtaataagtacaactcagttcaggcatctctgattgatcctaccctgaactggaaaaccaactctataacgttctataattctaagtttaagaatgaagatcgtggagttgacaagaaacttcaactttcttttgctaacataaccaactactacactgctagaagcttggcagatagagagcttaagaagtctcgttactctcgctctctgagtttctctttaccttacaaattccttggtatagaacctaacgatcctgtagtattcacctacgatcgttatggctggaataagaagttcttcctagtagatgaggtggagaacacaagggatggtaagataaacgtaactcttcaggagtatggtgaggatgtatttattaactcaacgcaggtggataacagtagcgaggccgttcctgaaatatccaataacgtcctgccaccaagagactttaagtacacccctacaccaggtggaatggtaggtgatgttggcaaaaacggagagctttcatggcttcctagcttgacacctaacgtagtctattactcgatacgtaaatccgaccgcgtggatccttatattgtgcagcagactgctttcacacctaacgttagaatgttccaagatatcgtgggtgagcctgctggcctgactattttcgagatccgcgccgttgatattaatggtcgtcgtagctctccagtaacaatttctgtagatttgaactcagctaaaaaccttagtatggtggaaaacttccgagtgcttaaccttgcccctgaccctgctgaatgggtaggacctgacttagagttagggtgggacaagctgcaagaagaggggctgatttcagggattttctacacgcttgaaataagggacaacactaataaactgcttagatccgcaaagatcaccagtttatataactacagctacctgttgggctataataagctcgactacaaggccaacaactcgaatactttggggatttacagagcacttcagccaagaattcaggcggagggaccaaagggcgagaagtcggttgcatgggcatatatctaaatgatttcaaacatagcaccagctaaaatggtactgcagaatatcgtgaccggctatacgattgcgagtattcagcactcaatcttttccgattacgacgtaattggtagaactttctggctaactacgggtggggtaactacccgtagggactttaccggcgttgatacattcattgccacaattaacaatctaatcgctggcgctacctactctgcccagggtgctttctatgactcgatggttgatgcagagctgatggctgctaaagtaggtatgaacctctctagcaccattaacttcaagatgaaaactgctccgaagattaccaaagtgtcctcttttgcagaatctgttgacgtgggtgtgggtgctcctatggttgtcgtagagctttctggggaggccgaatacgttaccatcgaaatgaaacctgagggctctagcacctggactaaatactaccgtggtccaatcactgagcagatcatctttgggggtgttccagttggcagatacaatatccgggtatctggtgttgtcactatgccagatggtgttactgtggatgtttctgggtatgatacctggccgtcactgtttaacctgacctacaacttcactccaccgtctgccccaactaacctgcgtttcaaaactgcccacatccaagatggtatggagcgttttgacgttcgcctggaatgggattggactcgtggtacgggtgctaacgttcgtgaatttatcatccagtatattagtaacgatgagtttgcaaaaactggatggactaaggccaacaagctaaacgtgggtgcagctaaagctggtactatcactagcttcccttacaaaatccgccaccgcttccgtgtactatcggttgcttggggcccagatactcagtctataactaactctaacgaggttacttatattatagacgagagcaccactttcgacaatgcattcattaacgagaccggtgtagaaatgacctacgcaggtatcaagggtaaactctggaactctaacaccaaacagtgggagcagactttcttagtcgatgctgctacaggtgcagtagttcttggtacactcgatgaaaatggtaaagcgccgatttcattcgaccctgttaataagattgtaaacgtcgatggtaaagttatcactaaagacattaatgctgctaacgtaattcttactaacctgaccggtaaagataacccggcaatcttcactcagggtaagaagtacggtaataacgcaggtggtgtctggatgggtgttgacaacgttgacggtaaggccaaatttgacctcggtaataacactcagtatgtgcgctgggacggtgatactcttcgcatttctggtaacgttgtaatcggtactcctggaggcgatgtagaccttgaaaccggtatgcagggtaagcagactgtatttgcttataaacttggtacatctctgccaagtcgcccgcttgaccaagtttatccaccagctggatggtccgcattcccgcctaaccgcactgctcagaatcagaacgtgtacgttgtgcagggtactctggatcctaagaagagtcctcctgctctagtagacggtaccaactactcagctgcatcccagtggtctggtgtcccaggtactggtggtactgatggttctaacggtgattacactgttcagatttaccagatcagtgctagtaagcccacgaaaccaggcaatatcaatgaccctagcggttggagtcgtaccccaccgactggaacccctctttggatgtgttctggtagattcaatggcgatactaacgctctaactgttgagggttggtcagacccgatccgagtagacggcgagaaaggggctactggtgctactggtgctactggtcctcaaggtcctcaaggtccggcaggtggttcagtagaagtacagtggtctaaagatggtactactaactggcatgcaaactttactactggtgatatctacatgcgtcagcgtgttggtacaggtgggtggagttcagctatccgtgcagttggggaagatggtactaatggtactcctgggtctaagggtaactacattgggatgcgcttccgagtggcggctgagaaacctgccactccgactggccagaccccttcaggttggtcagatgcacctcctcagggaaaccctctatggatggttaaagctgagttcaacggtcaaaccaacgccctagtaggtacgtggtcagaaccagttcgtattgatggcgaaggtattggagtaaacctgtatccggttaagaaaacactggatcagtggaccggaatgagcaacggtactatggttaagaacccagataccctcagctttaccataaccaacacagagagcactacctcctctaccggaccgggtgcacatcctgttccgttccagggttcacaaggtcctatagttgagattccagtaaagccgaatacagcgtacatcttcacttatgaggttagtactgatagcaccagctttgttctgagagacctgttactagagttctctagcattaccggaagttttaccaacttccaagagttactgactggagccaaaggtaagcaggaagctaagattgtcactcgtgctgatactaagttcctgagcttccgtccaggtgtccgcactgccggagctacggttacttattctaatctaaaacttgaagaaggcattaaagctaccgcttacagcgtagaggcttccgacagtatcggtgagaaaggagaccaaggtactcagggtccacaagggcctcagggtaatcagggtccacagggtaatcaaggcccgcaaggtgctaagggtgataatgcaaaaggattcagcctctcttctctcggtcagacgtttacgtacgacgcagaaggtaaactgaagtccgatgcaaccatcctgttccaggctttccgtcagaatactactgcaaacgttacttggtcagccaaggacgagaaaggtgggaacatcactctgacaagtactagcaatactggtgctacactgaccgccgctaacttcaaaacatcgaagtctgtagtagttacagccgtctgtgatggtatcaccgatcagatcactattgtgcgtctagacgatggttccaacgctctcgtagggcttctgaccaacgaaggttccacagttctagcgaactatgctggttacgtgcaaaactatagtactggttctggtgacttcaaagtattctatggggcgaaggatatcacctcagaatgcaccttcagtactatggagaagaataaccttgatgctgatattacttcagcgggcaaatatactttaaaaggtatgccggctggtactgatgttatcaacggctgggtcgacttacgtgctgtacaccctacttacggtgccgtggtccgcagagtggcaactactaaatctatccttgcaaaaggttatgatcgcgttattaccacttcattcgagaacggaaataagggtacctggtcgactggtagtgtccaaggggtttctggtgccacaattgtagccgcaggtttcagcaaggccctagtgatctctgctagagactgtatagaagatgctaacgcattccctgtagtagctggtcagaaatatagactgggcatgtggataatggctagtgagtctaaagtcaatatcaacatgggaatgcgaattgtaagggcggccgacggagttgttgattggcaaggaacccttatgattgcacaaggtactgtagtacctggtggctggtcctacatcgaaaaagagtttactgttggcagttctaataccggtatagcaatgccgtggatccagatggctgggtcttctggtagtgacttaggtaaagcttacgttaccgatattcacattttcgccctagaaatggatggggagaaaggtgatactggtgcaactggtgctacaggttctcaaggtccacaaggtccacagggtaataaaggggacaaaggtgatactggtgcaactggtgctcaaggccctgctggtagctctgtaaacgtccagtggtctaaggatgggtctactaactggcatgctggtttccaacctggcgatattttcatgcgtcagcaggttaatggagtttggggcagtgctattcgtgcagttggcgaagacggtaaaaatggtgctgatggtactgacggtgactacatttcaatgaagtttatcgttcaggataccaaacctggcacacctactggtaacaacccaggtagctggagtgatgctcctccagttggtagccctttatggatgactaagggcactatgaatgctagcggtcaactacagggtacgtggtctaatccggtccgcctagacgggactatcaaccctaacctgttcgcagtacgtaagtggatggcagggatgactggtacggaagccggcacatctaagaacgatatcgagaagctagcgcataccttgactcgtacttccggaactgataatacggctccagggtgctatgcgaccccgtatctaggtagtggggcgttttcccatccagtgactccaggtaaacgctacactctaacctataatatcgacgcggctagcgaggtccagacccgagatactatattctggcaggctaatccagactcaggacaatccacctacatagaggaactgaataccgggacgtctataaaggttaagcgtacctttgtagttcctacaggtatgaactacctaaccctacgcccttctgctctgacacttaacgtagcgactacgtggagcaagattaagctggaagaaggcggagagaaaactgagtatcaagtagaatactcagacagtatcggtatagtaggtaaatcagttttagtacagtggtctaaggatagctcttctagtaactggcatgataccttccaaacaggtgacttgttcatgcgtcagaacgttgacggtgtttggggtcctgcgattcgtgctataggtgagaaaggtgagattggtcctgacggtaagaaaggtaactacaccaatatcatcttccgtatttcggatactaaaccagctaaacctactggtaacaaacctacggattggtttgatgctccacctgatggttcccctctttggatggcaacagcaacgtttaatggggatactaacgctatcattggtgcttggtctgaccctgtgcgaatcgatgcttccggcgtaggcgaaaacttcttagcgttcaaagagtggatgatgtctattcagagggctgaggggacgggctcttcagttagcaagaatccggaccagatgagattccgggtaacagctgggccatccagaaatgacgcgtacactaccccttaccaaggaaccggcacacattttatagaagtgtcgcctaatactgtgtatactttatcatttgaaatggaaactgctgtgtccactagaatgatgctgttgcagtttgataatggtaatgggggcacgcacgcacgtaacaatcaggttatatcaaccagtactggtataaacagtctgactattactacgggtgctaacactacccacctgtctatgcgtatgtcaatctctaacatgggagagactaacgtactgatgaaacctaagctggaactcggggcgtttcctacggcatacgtggcgcatcctagtgatctacttggtaaagatggtgctactggagctactggtcctcaaggtccgcagggtaacactggtgctactggtgctacaggcccacaaggtagtaaaggtgacacaggggctactggtcctcaaggtcctcaaggtccgaaaggtaacgcaggtgaaaacgctaaaggattcgccctaacgtcagattatcagtcattcgtgtatgatactgtaggggacattaaatccgctactactattctgttcaagggactaaaacagaatactactgcagggatcacgtggagtgctgtaaataatacgggagctgcagtaacactgatgaattctggagataaccgtcagctaaccgctgcgaacttcggcgcctctaagtgggttacgataacagcaacctgtgatggtttatcagatcaaattactgtggttcgtttgcaggacggtgagaacgtgttgaccgctgttatgacaaatgaggcagctacggtacttgctaactactccggatattgccagagttacgaaaacgccaaaggtcagatgagagtttggtacggaagcaccgatgttactggtcagtgcactttctctgagggcggaagaagtaacgtaactcctagcatcaactcagcaaatgggaactactccgttactggtatgttggatgggaccgatattaccgaaggttgggtggacgttaaggctactcatccaaaatatggagcaattaccaagcgttttgcggtaactaaggtattcctagccaagagctatgagatggttatcaccaataccttcgagaatggtaacaaaggttcatgggcaggagctctgcagagtgtttccggcccaacaaaccagagcatctctaaggcgctgcgtatcacagctagagataacctagagggtaggaacaccatcccagtagcaggggggcaaaaagtccgtatcagattctggtacaacccactaggattagaggaagccatttttagagtaggctttattgttcaccgcaaagatgggggcaaaggttacccctccagaactgtggttacgggccccgctcctaatagctcctgggcgtacttcgatcaagagttgactctaagtgctaacgatgagggtattgcctggccgtggttccagttagataacaaaacttctggttcttcattagggtatatgcttgttgctgacatacacttcgaagatctatccatggatggtgcagacggagctactggtcctcaaggtccgcagggtaacactggtgctacaggtcctcaaggtaacaagggggatactggtccacagggtccacaaggtcctgcaggagcttcagttggtgttcagtggtctaaaaccggcaacgcgagcgattggcacacaaactatgctactggcgacatttatatgcgtcagcaagttaacggtgtgtggtcttcggcaatccgcgcagttggcgaggatgggcgggttggtgctgatggtaaatatacctccctgagattccaagtagctgcaactaaacctgctagacctacagggaactctccggctaactggtctgattcacctccagaaggttccccactctggatggttaaaggtgagtttgactccagcaaccaacttcagggaacctggtcagatccagttcgtctggacggtgagacggtcaacctcaacctgtttgctaacaaagcatggattgcgtctataacgggtgccagtggtagtggatctgttgtagccaaaaaccctgacgaactacgcttacgcattaccgcaggttctggtgcaactgacgcgtataccatgcctagtggtggtgatggtacgttcttcactaaagttaccgcaggtaagcgctacactatgtcgttcgacacggatagtgctctggaaatgagaatgcatgtgttctttatccaggcaggagcaaatactactacctcatcattctcttggatagcgtcaacaactgctggcagaactagctggtcgttcactgttcctgcaggatgtgatagggtatctgtccgtgtgtcactgaacaacaacccaggtggaaccaacgttgtttccaatatcaagctggaagagggagatttcgccacagcgttcattaggaacgagctggatactattggtgctgatggttcacaaggcccacaaggtccacagggtagtaaaggtgataaaggggacacaggagctactggtccacaaggtccgcagggtccaaatggtactagcgccaaagcctttgccttaacatccgatagcctgtcctttagcttcgatactagtggtaacctgaaatctaatggtactatcaagatcgatagctggagacagaataccactgctgcaataacctggactgccaagaaccaagcagggagtaatataactttaggtggcactgctactaacaagactataacctctgctcagttcggaagctcagagtacgtaacagtaaccgcgacgtgtgatggaataaccgattccattacaatagttaggctgcaagacggggtgaactctctagtcgggtacttaactaacgaagcggctaacctgtcgtgtaactcctacggttttgtgcagaattgggatggcactacgggtaactttaaggtgttctacggaacggtagatgttaccagtcagtgtaccttcggagtggaggataagagcaatcttaacggcaacatagggtcaagcggttattatgcccctagcgctatgccaaacgggctggaaattacctctgggtgggtagattataaggctacgcatcctaagtacggaacacttattaagaggtttacactcaaaaagagcctgcccgggattggttacgacagagtgttcacggggtcctttgactctggtaacaatggatcgtggggacgtacggtagttgacatcgctacgggcagtcccggaggacacaccaaggctatacagtgcacctctagggacaccatggaaagtagtaactggttccctactcgtaaggggatgcgctaccgtgtaactgcatgggtgaacaactctgagggtgagtatcagctaaggttaggcctccatacccagaactcttctggcagcgttaacactggttacccaactatgctagccgcatcagctaaggattccgagggatggaaactagtaactggtattgtcacggtaggagatgggtctactgcggagactggtagggcaagaccatttatccagatgaatggtagtgctagccccttcggcaacgcttacgtagctgctatagcgatcgaagacctatctatggatggtgcagatggggcaacagggccgcagggtccacaaggtaatactggtgccactggtccgcaaggtgataaaggggatactggtcctcagggtccacagggtcctgcaggtaactctgtaaacgttcaatggtctaaggacgggtctactaactggcacagtacgttcacttcaggtgatctgtacatgcgtcagcaggtgaatggatcctggggtcctgcgatcagagcagtaggtgagaacggggctaatggtacgccaggttctaagggtaactatgtgagtatgaagttcgccgtaatggctagcactcctagtaggccttctggtagtaatccggctggctggtcagatagccctcctccaggtaacccgttatggatgattaaagcggagtttaatggggagactaatgctattataggtaattggtcagatcctattcgcctagatggggatagtattaacgagaacctgttctactttaaagcctggttagactcgattaccggagttgcaggcaacggttcatctataggtaagaactacgagttactaagggctaggataatcgcaggtacaggagttaccgatgcgtataccctcccatcagatggatccgcctccatgttcacctaccttcctccaagcaccacatatacgatgtctttcgagactgataacgctgtagaagttcgttgtcacgtattttggtacgctaagggaagcaataccactggaggagtgctgaagactattgcatctactactgcaggtttgagcagctttaccttcaccacgccggctaattcggataggatatccgttaggttctcagttaacgaatctgggggaaataacgttgtaggaaggtgtaagattgaaaagggagccttcgtaacgtcatatgttcgtaaccagtatgacgctgtaggggatcgtggtccagggttctatactcaggcgatcacaaacttaaccggatggaacgatactcaggcagcatctttcttccagtcaacatttggtggacctccggttaagtatgacgtactaactcagtataagtcgggctctccgcagaactcctggactcgtcaatggaatggctcggcatggacagctcctgcattaactgttcatggtgatatgatcgtctccggttctatcactgctgataagattattgcaaacaacgcgttcctggcgcagattggtgttgacatcctttacaatagggccgccgcactaagctctaacccagagggcacttacacaatgaaaatagacctggctaacgggtacattcatataaggtaacaaatgagcacggaaaacagagtagttgatattatccttgatcaaaacgtgtcatacggattgatgctacagttcatggatatcgatgactctgcgtacccagcaacggaaacccctgtcaatctgacaggggtaacccttaagtcttcaattaaagactctctggaatccactggggtaaaattagcagatttcgtcgtaacagtagtaaacgctacacaaggtcaggcgtcgctaggattaactgcggctaccgtggcaacaatcgttagtaaagcaagtaaagaacgagataaatataatcctagacttcggttcgcaggttactatgatgtaatcatgaccaaaggaacaggagctaccgctacctcttatagagtcatggaggggagcgtgtacgtcagtgatggagtaaccgcgtaatggctattacaacaagaattattgcacaacaggttaccgctcttgacggagctaactcaagggtaagtaagtacccaaaatttaccgtacagctaggatactcagttagttctctggctgctacagaattactagatgctgccactagatcggcagcatccgccgccgccgctaaaacttcggaaaccaatgctaaggcttctgaaaccgctagtaaaaattcccagacagcagctaagacttcagaaactaacgcggcagcatccgcccaagtagctcagaatttggcaggtaaagcgtccctagtaacaccactaggagtgatgaccggctcggcagaagctaagattgcatctataacaatagccgcaaatcagtcttctagcgttcacgtattatttgcgctctacgctacaggtaatggagccaacagggatgatatatacaatatggagatagtatccctggcattacctggtcctgtaacctctgtaaccgcggacaacatcggcagcttccttagtcatcgagtaataggtccggccaacactaatggatttatggtaggacttaaatctactattgagggtagcaacgtgacctatgatgtatacctcaaatctcgtagtagtttcagagaccctaagatggcattcttatccggctccatatctgttactccacctaccggacctttggtggacggaacatcccctgcgtggaaaactacaggttttgatactgatgttatctatgtaaatagggcgcaagtaattgatgatggcattagtttagcccgcatcaaacaactagctataactaacggtaaaaccgatagctctatacttcttttatcctatttaaatgaaacaggtatactatctaccaataagaagtctatttccctccggccaggaggtacgagtgactctagtattgcagctacggagtttctacctaacgggaatataattctgcctaatggggatactgggaaccaaactattagttggttaggtggtccccgcatacgagtcaactccaacgggtcttttgttctttctactaataatcccagtaatcaaactagtgggtttataactttcaggccacaaggtgatcaagtaacttccactgagcttcagattagggatgatggtaacattaagcagacagctccacagtcatcggcaggcaatgcacttatacgccaggatgcggctattcaacatatcatggataaggctccggctgccggtattactgctaaccccctaagcgacttgaacgtaatacctacgcctgaaggtacagatccttggggagcagacggtgtacgtgtattccaatcaggggtatcaacaaaaaatactccggacggaactactggtcggcttggaactatcctcaacgttaggcacacccagtaccgtataatgcagttcttcatgcagagtaatgctactgcacctattctgcatattagatcattaagggctgatcagggtaataccccaccggcatggtttaaagtttatacagaatactctaaacctaacattcagtctgacatagcaggtattactatagacggcaatggtttcgttaagaaagcctccccgatcgccaagctcatagccgaaattcctagcaaagaggattcattcttctggacaggcgtggaaactgtgggaggttacgtagggtgtaacgcagaggctcaaggtgtatttgctgtaaaaactggactaggcaagtatactattaaagggagtttaggctggaacacggaaggatggaaatttgagctaccaagagatgataacggcaatatgttgtgcttcgtggaatcggattggaatgaggaagagaaagagctaaacatacaggtgttcacccgtaagtttgatattaacacaggtaatatcatcgctggtgaacctatggagataccacaaggtcgttggattgatctacgtctggaaatgccaaaagtggaaataccagaagtggaatttccagaagatccagaagtataataaaataaaaccccagtcggagcaatccgctggggtttttctatttacatcttaccagaacttccgaagccaccttcgccacgatcagtgtcggtcagactatcgacaatttcaatgtcattggggttataatgaggtacgatcaccaactgacacagacgctcaaagttatcaatcggttgtgtctcgttgctcatattcaacaggttcatcttgatggttcctcgataatctgagtcaatcacccctgttgtattggcaatcattagccgacgtttccctagagaacttctcggaaccacgattcctacccagccttcgggaatctcaaccgcaactccggtatcaatcatcaatgactccccaggaggtatggcacgcaataggtcggaagcacgatctccgaagtaggcccgtagatccataccggctgcttccgagcttccaacgtgaggtttacaatcggggtgagataatttaatacgcattatacttctcctgtggcaatagccgtaatgtctttaacaaattgatcgtagatatcttgtcctgctgcggcaactgcttccccacagaaacttgggagatctactagagttaggttacgttccataagttcgcctgatttattcagagcctggacgaatttttgagttcctgggagcggtagtgcatcaataatgtctagcacgctaccatgttcccggattaggttgtagccacgtttttcgccgataccttcaacaccacgaatgttatcccccatatcgcccataatggcttttaatgagataaactgatctacagtatctacgttatggttgtcgaacatatctttctcgtgatattctttacgagtagtaaacgagaagcgggagatattcggagcaagcagggtatcccagtcaccgtctgtggagatgagccagatatgatcgtagtgatgacctatcagctgaataatgaaagccgccatgtcatctgcttctactccgcggattcggaaagtagggaattggcttgcaataagatcaaacgcatcgtctaagtattcaaagaattgacgatccgcctctacttccgcttcggagcgatcggcgtacttagcgtctcggttgcccttatactccgggaaaatattggtacggaagatactcttccctttatcccctagaacgatagtgtgcttcgcatcgtaggagtttgccaaagagttgatggtgtttgcaaaggatgctgcaataggcttaccactatctttcttgaagcggaagcctaagttcgtaccgtcaacaatcataagattacggcgtgaggcgaggcgttgttctgcctctcgtttcattgttccccaggatttactcatttaactaaatctccaatttcacatgcgtttaaccacggctcaaaaagaccgataacaatttccattccacgtttattaactatgaaatgtgctctactcatgaggttatcaatcatagggtcgctactatccagagcgataagccattgaccacgatctttcttaaagatcagggcgggtttcatgttcatttgctcaccttcacgtgcggcttgggcccaccatttttctagctgggattctccaacgtttaggatattgctattaaatttttcgtctgcgtagtgtttgatctcaaaacagtattggctcattttacctacgctaggtggcagatacacatccccctttagggagtgggattggccaaaagctcctgaaccaggaacacgttcccagtccaaggaggtatatttacgcagcatatcacggatttggtattccgcgcgttttcctttctcgcgactatctacggccattaggcctccaaaattgataagccagcttcgtcttgtttaacctcaatcttatgtgcatacggatgtgtgtgcccgtgagatacgatgattgagttcagctgatcttcttcctgtagaagttctacgagggtattaattccatccgggtcaatataacttacaacttcatcaaggaagagcaggttgatattaactttactaatcgttgaaagcaacattcgaattgctaatagcgtggaaatattgatacggctctgctgaccagtggagcagttgaccatagaagtcctgttaccatcattgtagatgacaacctgtagcttcgtctcgtctaactcgaaccctagagcaaatttaccgctggtcatgatagagagataatgattgatcatctcttcaaataccttgacactatgctccagcttataccctaccagatcttttagcccggtaattaagatatctagatccgctacttcttctgcaactaaggacagttcagcctggatcttatcaaactcctgctcggccttttgaatctgttcacgcttagcttcatatttcgcattttcacgtacaactgattcgttatgggttcttgcaagttctaccgaggatctgccttgacgaatgctagactcaatagctttgatacgctcagctaacccgctagcgtctacgatttcatcctgcgttccattgacctcatcaaattccttgaggtttttgcgagcctgttccagagcgttaaacttagagatataatccttaaacgccctatcttccttcctaagttcttcaacttctgcttccagcttttgacgttctttatagagcggatcatactcctccttagttcgtctcatagcttcttgggcggcggaggtatctaagtgagttccgcacgcagaacactgagttttacctgcggcatttttgaaatcgtagtaacgtttcttcaaatcatccgctctagttgccacgaccgttaggttacgcgtaacactcaggagttcctcagatttcgaggtgggcgcaggtaaattttcgaatggtgcaaaagttttttcggcagcttgtacggccatgtccaaagagctacgttttgcaatactggctttttgcttctgagccagtgctaccttgacttttgcttcggttaattcttcgactagtggctcttcatcgaaaacagggattgggatctctgattgaggtgcgccaagcgaggcttttgaggaaagtatagattgggcagttcgcaggctaccttccaatccggacagttttgccgagacggctttacgtcccgctttaacacgttcagaaacttccttatattgttcctgatcaaacaggttaacgaggaaagtcttgcgctgagcatccgtagtcttgaggaagtcgagactggatccaactgactgatatacgagcttagtaaatgtcgtaaaatcacaggcgagtacctcttctatcagcttatacgtttgggttgcggtgtgtccgctgatatcttcaccgtttttagtgagagttactttggcggttgacttcacaactttcttgacgttgtacacgtcaccgtcttttgtgaactgaccttctagcgtataggccttggagccagtatgccagttaaacaggtcgtccttcttgataccacgtgagttcttattataaagaagctcctctagagctgtaccaattgttgatttacccagcccgttacgcccgattaactgagttacgcggtgattatcaaattctatcaccacgttctcagcatatgacataaaatggctgattgtcaatttattaattactatcgacatactcagcggctctctttaatatgcgtgttctagacgcttcgtctagtttctgcacgtttgtgaaataagtatccagctcctgtagcagtgacatatcgtctagatctaacttagcatctttggtgacacggttattgatcttcttatctaacagttcgctgttctttaacgttttgagttgtgatacgtcgccggtgacttcgtatataactctgtcatacgcatcggcttccattggctcgccgacttcaatagtttttcgtatgagctgtggaagatctcccagttcaatccacgaaaggtagtgctcatggtctcttggcaagaccgtatcgatgataaaagctccgttagttccttttgtcctttctctgtgaaacgaagttgtaagcggagatccgggatagagcaggtcaacatccccgatcttttggctgttcttgtagctgtggagatcgcctgcaaatactttggagtacccatgttcgacgaatctttcgaggtagatttctggtacgacatgaggcgggattgcacctctgacatgcgtgaagcaaatgtctgaaactctgggcttccaactagctttgtgaaggctgctgtaagggatgatatcgaactctggagatcggtagtctttgacgactttccaaagtccatctgttgcgtcgctaattgctgctgcatagtgatccaggcaagaaatcgttttagatttcatttcgtggttcccggtgtaaataataccaggatgttggagggtagctaggaatgcaaacagtagttcaacttcttctgaagacgggtctgaaacatccatgatgtcaccaccaataatgtgaaggtcacatccagtagctccaaacacttcgtccagcttttcaccgagaagaataaaccgatttttctgccattcctgaggaacgttcttcgctcctagcttgatgtgatgatctgctgagaaaagtattttcatagtcaaaataaaagggagccgaagctccccttgtttggattaatcgaggtcagaagctgcttcgtgatcgatgttaccggagttcgcggaaccttcattacctttagattcgtcgccctcctcatctttcttaccttccagccatgcctggattgctttcttctgctcatcataggacggaaccgggtaggtaacatccagtttaggcactttttcgaagccttcgaattcgtctgcttcgttgtacagagcctcaccaatcagagcaacgtcggcttcatgcagggcggcctctttagaacccggctgatttttagccatctggaactgcattgcagcgatctgctgtacatcgtacttggtatcgaagccagtaccagatttggagatagtgatatcgatctcacccggatcttccagattcagctgggccatgatggagtggataccggtcaggatggttgccttaacttccatcagcttcagtttgttatcagtacgatcgataacaacggccaggtagtttttcttaggacgcagcggctgagccttaccatctttcttctccggatctttgaagcccatgtcgtgaaccggatcggatgctccacggatgaaacgctctttttcacggtcgaaacgcaggcactcgaacggagccggtttaccttccttattctgaatccagtacacataacgcgggagaacgccggaaacgatacgtacaacgttcttaccgttgttgaacttcatgtagtccagtttgtcgccgttagaaccgccagtagtagaaccccaagatttagtagccatatttaattttcctcgataaatgtcaattttgacttgttgattgcgattagtgggtggtgctcgataactgctctaggaacccacggtggaatatattgcatatccagtgatgtatccttcgagaagctatattcggcatagtttctaaaactcaaaagtcctagatactcagccaactgtcggtctgacagctttcgtttattataaacgattgtatcttcgttcaagataaatgatctacccgttaacataacatgagcttcgggatcttcaaccattcgtctgataatctgtacaatcagcgatgagttacctcgtgctaatatgtaaattttttcgtaatcataaaacaacatgattattatacaccattttgagagaatttagcaactaagtttttatttttctgcttcggactttccgaagattcagttgctgttcccattaatttatacagatattatatcgtatttttgaggactcagcaactgaaatttttaactatttgcttaactcttctttgtaaatctgtctctcagttcaatataaatattatatcaaactttggggttcttagcaaacagaattttatctaagtttgccatattcttctcgttaaagtcaagaacttcccacccattgagacgatataccgcttctctacccgccgcctgcttaaatcctacacctcctagcttcagatccacgaggattgggtctaacttatcatctgccatacgttggacacgacctgccaactgttcgattagagattcgttatttattaaagagcctaacactaaacacgataaagcatttaatgatacaccctccgagaagatgctttgggaagccgctaacacacacggaccgtcattggtcacgtcaatctgtacttgctccctatcatcgagcgaagttacaccggtgatcgtgtaggtcttcacacccctgagttccaaagcattcgtaactctctcaattagatctatacgatcggacacaaacaggactttatggcctgccatcgaatatagctcgcacaagtcaacaacctgttgaaagtattctggctgcgaatatacatcgttagctcttatcgcccacggcacattcatatttccagaaacctgcgtttttagcgcaaacctatggatagtaggtggcatagtgttatttaccggaggactatatactttcgttccaaaatagtccttaaacataacctgcaaaccatccttacgttttaatgtaccggatagcccgattttatatcgtgccgaagactgctctagaaacttggtaaacgtggtggcaacgcagtgatgcacttcgtcaacaataacggtgccgaattcttttgccaaagcggctccgtgtttgttaactgtctgtatattactaataacgataggagaatcgatattaaatttgccagacccaataactcctggctcaatcccaaagaacttgcgtacctccttctcccacatagctcgaatggtagtgttggtacatataactaacgttttctgcccaagtttatgggcgatagcaagagcaaggattgttttaccgaacccaggcttaccattaataatacacgtatcattacagtcttcatatatagggagctgatcccctggtcgcagggtgaacgatggctttggaatatccataggaaccagagtacgtttatctacgatctctgtcactttttgcccgaaagattctagaagatctaatctggttacgggaaaccacttgatctctttacctaccgatcctgagttctggaacattagaggatactttgccccaggtttaaagatctggtatgaagtgtgttttaataagtattcccacagttcgttgctgggtttacaatagattttattagatataactatcttcatatcttaactctaagtctaggagtttctggctcctcttcgtgcgtgtcaaaaataactggtgaaccgcgaaccaacgcgtacgaaatatagttggcaggttcactaagtaagaaaggatatggaacgttcttgacataacactggtactttccgttgaagattctagttgatcctctaacgcgttccgtgataatgttgtaataagtcgtaggtttccatgttactatcttacctgtggagtcgatgaaatgctttagtccagagtttattatctgagataagtacttgaactgtttctttaaaggatagagcttataaggtaaattttcccgctcaccataaagaaaaagccttcgctgagagaatgtcccaggaaggcttggattgtccagcacataccttgtaaatctcgtctggataacaatgtactccccctcttggaagagtacatcataagcccttaaagcatatactggtaagctaaagttaagcaccaagaaccctgcgaacgttgacaatatctttgctgatttccggcaaaaacttaatattggcgtacttatcgtgatcagggtggttttcatcgttagccgcaatagcagcgtagtcgaagtcctccataccgataatactacgtactttctcctcaaactccttgtcctcaatgcaagcaacagaaggacgctgtttcttgatcttaccacaggagtaatcacgagaaccgccagcctcggagtcagagtcgataccaataggacagcccggaatactaataccacggtctacctgaatgttacggattagcatctcgttatactgatcaactaaatcctcacgaacaatggcaaccacggagtcgtgaaccagcatgataatcttcatttcgtcctgcagacccagagagcgaatctcattatcggtatcgatagcgcctagcaggagactatcagaagatgcagactgaatgatggcgttgaaaccagaacgcagttcttcaccctgtacaccacggtcttcggagttaatgttgtgcagacgacgcttacgaccaaagtggctgtaaatgaagccgttagtttggatctgggcatgagatttatcgatccatttcttaagctgagggaatcggccaaagtaggtttcgatgtactctttcgcatcaccagtagtacattcagtgtacggtttaccggtcttcatgtgctcttctaggagagcttcgtttactgacgctgctactttagccgggccagaaccgtaaagaataccgaatgaaatagcttttgcagcctgtcgtagtgcaggatacagttttttaacctcagtcggtttacacggcagagcaaataccatgtgtgcaattgaaccgtggaagtctgagtagttttccgggtcgttctgcatgttgataaacacttgctgcatgttaatgtcaccagacagtacagcggcgtagtaaatctcagcagttgttaagtcccatgcgataatacgataacctacaggggcaacaatacaacctttaataacagactcatcacgaggtaactgctgaaggttcagcttaccagacgaactcagacgaccggatgtagtcatatggatatggaatccagtacgaatgcaaccgtcagcatcaatactgatcagcatcttctcgatatacgtcgagagcagcttggagatcttacgaatctctagcagagtcttagctatcggatgctggtccgaaagctctttcagggcatctgcgccggtggaatctgcacccgtatctgtcatgatacccgtcggggttaagccaacataatcgaacaggagcttacgaagctgtacaacagaggctgcgttaaatactgagccctgatcttcctctagcttacgaacttctggatactcatacagcttagcttttgcaagctgtagcgcagtcattaactgaacctgagcctctttcagacgatctttggagatcggtacaccacggtcttccatacgctgtaggaatacacatcccggcatcagtacatcgtaatacagagacttcagtcgagggttagcttcgacttttggcaggaagaaattggatagacgcagtgttgcatcggtatccttcgctgcgtaaggccacatgatatcaaacggaatgagatcatacgagaaatcctctttcttgatcttatgcgtcttgcaatacgtctccttgaactggtcgagttcaaaatcgtagtcccccatatcggtatacttcatcgccaaagatttcaaaccgtgtgtaccacgtcgttcatctagggcgtagtgcatcagcatggtatcgtggaggcgtttctcttctgctgccttatcaaaggatagacctaagtgatagcagtagaagtgcatatcaaacttcaagttatggaacacaacgccatgctccgggctatcgaacagtttctgtaagtaatagacggtattttctgtgatgacgtctgcatcaatatatacgccctgatactcttggtgggagattgagatccccagcatgtaaccatctcggcagtatagcgcactggtttcggagtcatatgcgatcatgccaggacacatggtatacaccatcttcacatacgcttcggcttcgtccgggcactgaatcgggcggtaatcccctgctttagagcgtttttcacgaccattgagaatggcatgaatgctctctactgtggcttcaaatacaggcttcatttccggtttaaagtggagctgggccggactgatacttgcaatccagttagcatacccatcatgctcaacacgtttacctgagtaatcggaaatgccctttttagctgcaaacttcaagaacgggtctgcacctaccagaataacgtaatcaaaatcttccggattgaacgggttctccggtgttccgatagtgatatgtttcttgagcagtcgcccggttactttctcactagccatgaagaaggtctcaacctcatggtcaaagagttcgaagtgtttctgatagcggacgttattcggtgatttgtctacaactgcgattttcattgatttctcctattaggtaagcaagtaaaacgtcagtgtttcttctcaaacttacccaattattatatcaaatcttgacatgttcagcaatcaagatttctacgtttctgatgagttggtcgacttcttcagcatctaggtctccagggtctttgccctctggaagcaagaagttacctataattggtataattctagtcttatcacggattaatttggccaacttcttagccgcctcattaccggacttatcattgtccaatatgatgactacgtgagtagtaccggcgatttggaacggcatgaatttatctgcaatgttatctagtgagaactggtgagtaccaaaacaacatgaaacgttatggcaacctttatcttctagattcaacatgtcgaatataccttcgactaggattagggctggggtgttatagcgaacagggaagattgggggggagaccttcttaggtctaatcatatatttcggaggggcagagctatccatattacggcctaagaagaataagtttctccctacggcatccgtaataggaaacactacacgaccttcccagtcctctgtttgttggaatgcaaagtatttcttgaaagtctctgctttgataccacgaaagtcttgatcgaatatcatggctgattctggaatttctagactgcgaccctcagttcggaggtcactaatcattctgcgaactctcaggagtctaggcgacgtcctgtactgttcttcattgaagtaatgaaagatgcttggtataccacgaccaaatccgcagcttaggcagtggaaaaccccggaatcggggtcaacacgcaaactaggatgagcatcctcatgatcaggattgagacagcggatgaggatgtccccacccgtatctctgtattcaatccctttgagatctaaaagctcggttattctactcataagtctcttgaggattctccggtgggattagtatcctcatccgaagcctttttcctttttggtttgtctttcggtttatcgctttcaagtgggataacaaactctgcttccatctgacgaatgtcctctagcttaaggtcagaagtctgatccatacgcagtgagttccagttgatcttcggcatgaatgtcataccctcggagttacgagtttttacgaagtcgaacttgattgcaccgtcatgcccctcgttctgtttagcagcatttaggtttgcagccatatcacaggaatcgagaatacctcttgccatacgggcgttaccctgttggtcaatctggtaaggggctacaccagcaacgttatgcttttggcacgtagacttgaatgtagaggagacaaccatctgctgcttccaatcgtacatatctagtgtcttcgtatccggcaaacgtacctggttgatgtagtctagcagggcgattgttaccttatctccatacttggaggttagcttagttagttcaacatcgatggttgctgtactaagttccggatcatacacaatgatcatcggagtgtgcaggggtctttcctgcattagcatagtctccatgtcatggaaatcactcatctcgttgagcgtataacgtgatacaaaatcgttatatacttccagaccgccttcaaacatttttgcacgagtcttcgcaagtttgttgagttcaataccttgtaaggagtcattgcgcatagccttagcggaaacaccggccataatggctaggttacgtctaaagacctcattctctggcatttcgatggagaaatatggggcgatatccccgttgtaatattgggctacttgaatgttagaacagatgattgatttacctgtaccacgccatccaccgagtagcagtgtttcttttctggcaattccgccaagttgagcatcaaattcgtttgagatgccgagagagataagatttaacatggagtcttcttttctcttgaaaacacgcatagtatcggcgttgaagaccttaccagtcgttgttactcgttcctctagcttcatgtgcagagccgctactcgatcaagtaattctccctgatccagtatggtaatatcctgcaacacatcagtttctagcagattcaggaatagatcctgtgtgtattccgactctaggacatgaatcgcatgcgatatgtcaacgtctggaatctgagtgtttgctaaaacagttagtgcttgagacaaccttgcgtttctgttagactctagcattagagcatctaacgaaggcattccgttatgctttttgtaataattctggacagcttggtagatcgcggtaaatgcgtcattgaagtgatctttgcgcagtctagagaatgtctctagggccacctgcttttgatcggaggctaggagcattttcaaaactactgcttggacgttatacataagatactctctacgccgcgttagcgtctacttaaacgaaaaaggggagaggaacaaaattcctctcccctcaggtcaaatcaattacttggcggatttagcgtcaagtttagcgcgcttagcaacaccatcgtgatccttagcagagataccacggcggctcagcatagacttaacaccacgctcggatttaccagttgcttctgcgatctcagcaacggtcatatcggcgatattcagaccttccagaacgtcttcgcgtgccttagcattagagacttcctggaccggcatagcttcgatacggccttcacgcagcaggctcagagctttaccacggatctgcttaacggtacgttcgaactgagcagcgattgcttcaacggacgcgccactggcaacggcattaatgaaagcagcttcctgatccgggctaaagctacgtacagcagcggccttttcagtcggcttaacagccgcagtcagttccaggctcaggattttaccctgtacttgtttagcggtataagcaccaccaactacagcagcagcgatttcagcgtaggtatactgacccggatgatcgttcaggaatgcaaccagttcatcttcctgacccggagtccacggagatttggttacgtcggatgctttctgtacttcgaagccttctttacgcagtttagaaccaaccgaacgggcggtaacttctttaccagtttcagcagccagttcagcagcgatgttagcaacggcttcctgagagataacggtcgcgttcagagcgttagctttagcggtcagggatgcagtgatttcttcgttccaggttaatttagccatttttatttattctccagtagaattttaatcgtcaagacttcgatgcccagcgattgtgcttttttgtatgaagaagaaccgatcttggtttcatcttcgcagattaagtagtttacagccttagtcacggaggttttcaccgtatacccaagactttccagatatttggtagcgtccgcacgatttttgaagtcgttgagcttaccagtaatgcaaagaacaactccgttggattcagtcgccggggtaacttgagcttcccgcgccccactgaatttccatggtagattaattacgttctgtcctgccggtgtattcttccacgaagctaagttttctccagctttaccttccgctttcacagattggaaatcgttgtaaagctgggataatttcttagcagcaacttcaccgataagagggatactaagagatccaagaaccgaaccaaagtcaacatcttgtctcagcttagtttccaactctagctcaagtttcgtggcgactttatcacctacagctctgaccaaatcttctttagtcaggaaaaagagttctgaaactttcgtgatttccagtttagcaatcgtctgtgggccaaagccctttaacttcatctttgagcagaagttctcgattaatttactgctttgagctggacacatagacttgttacggcagaacaactgatcgttaactaagtccagtttcgaaccacaagagtggcaattcagtggaatttcaattttcattgattttcttcctcatcaatttatataaatattatagcaagaaaatcaggactaagcaatcgaaatttttcagaatttagctcagtctctcaccaaatatttctttccctcaactgaatgataatagtatacaccctggcgatgaaaatgtcaataactactttaaaaaatcatcacggtgtatctattgaatcaagtgttactcgtaaacacgttctacgatgcgagggatgaccccaccactacgaattacgcgaatctggcaaccgatttctaggtcaagggcagtgatataaccaacgttattcagggtagcttttgaaatgacagcgtcgtcgatgactaccggggtgaagtatccgacaggagtaactttaccggaagccccaacttgccattctacccgttcgagcgtagtaacctcgccttcatcatcttctttgatggcgtacgcaccacgcgggaacttgttagtccaacctgctgcgttaaattggttgttgccatccatacgaaccaccacgccgtccgttgggaaccaatctactcgactggagatatccagacaggtaacaaaaccatcaccctggaggatatgcatatctccacagaaagtagcggtcaggccaactttgccggtttcacactgaatactatatgccgtgaacatcaggccaccttccgcaatacgggagagaaactctccagaatctttcaggttaatagcaccagaggcgaagttacgcatattttcaacttctttggtgatgtgtacttcaccagtaatctgcaccggagtcttttgggagatccgtttagggatgttcagtaacttcacattatgagttacatcattacctaagacgccgttaccacgggttaacgcagaaacgaactttccgtcaatatacagaagtgaaatagcacagccatcgagcttcggcgtttcaatgccctggaagggtacttcttcgccgcggcctgggtacactttctgtagggagaacatacggaataggtgaggtacatcacctttagggccaatttcttcctctagcggaaaacgacggattaaggcatcatactcttcatcagagataatcgacatgcctttgtagtacgcgtcttggcacagcttaataaattctttaacgtgttgcattatttggcctcgtagtaatcgaacagcatctgagtcttcccttcccagtaaaagttttcgcataccgcctggaaggtggacattaccctacgcttagattttggactgtacaattcgcatactagtacgttcttctcataccacatgcctagcatctggaagcctgacattgtccgtactacaggtttgcccttctctttctctaaccaggttaggactagctcctgaccctgaagtggcgggctggagtatgcgttaagcgttatcttttgcattctttaatgcctcgttaacaattctagacatgtgtgctctcagctgttgagtgtgagcatacgtcttagcagcttcggtcagcttattaactaattgagcgatttcatgatctttcataaagatctcctttaaactatgagaatattatatcaaggtttaaaacactaagcaattgagattttaaagaaaaagccagcaacttagtcgtcactggcttgggtcttttgagattcacggtaaacttcatgaagaacctctgaattgcttagtattttagtaaatgcacggaatagcgtgctggtcatttctaacgtgtacgggaacgagaagcctgatttagtagggaaccagttatcttcaatatctagtaaccataatcggaaaccaaagtataaattgcctctaaactccgagacagtcatacgaatctgtcgcccttcatcttcaaagataacgtgggactgatcatcaatatgtccttcgtaatcctgacaaatgttttgattcatttttattgttctcagataaacaaaaagcccccgaaggggctgattgcgtcttaacgacctactggagtagctcgatcaagttcttggttgaggctggtgatgcgcttaatattcgcaatcggaatatagcggaatttatcgctagagcggctaaagaccaggatatgatctttgtcagcgggttccaggccttcacggacgattcgctcggccagatatttatcttgcttaggatcgaactcagtcgtaccgtagaggtaagttacccccttggtacgcagtttggtgtattgcatgcaaaactcaccgtgtttctcacagatagctacgacttgtgctttattcattgcaataccctcttatttagtgattttacggatagcttcagccaggtgagaggcagctttaccggtcagtttgtcaacgatcgattcgtccaggaagccatcttccagtccagcgtcgttaaatgcagcgcgcagttcagcctgagcatcagacttagaagtacggccaccagctttaggggcatcaccaccagttttagcggtagacttaccagcttctttcttgacgtatacgccagctttggacagcttcatacgaaggccgttcggggaaacaccgtgctctttggcgatctcagctacgatctccatggaaacgccaggacgctcatcttccgggaagagttcgattttggcgacgtaggcagaagtcagttcagcttcgagttcaggagaccattgagttggagtagacatatttattacttccttatttattgttaaaaagagtttttaagttttgtttcagactatgagaatattataacaagttactgagctgcaaagcaaacagaattttctaggatttggttaacagctaccaaaccattaggggacaaacgatacatcttcagcaaaccacgatcgtatttggtaagccagccattatcttctgcttcgtccatgggaagtgcatagtgcagatcccggatagctgtagcaccctcggaatagatctgaaataagttcaggagttgatatttactcacctttacctctcttttctagtttcagggctgcttttacagcgttattaaccagttcagctacgtcttctttaccccacttgaaccccagggacttgatatcaacaccaagtgctaccagatgttcgacagacgccagatcccaatacatgtagttaacatactgctggcgggcttcggacagcaggtaaacacgatacgcgcctaccggattatccagagcttttttaacttcgccaatacactgatagccaggaacccaaacgtgttcgcctacttcgaatacctctttcattgattcttctggaatcgcaggtggaaagagcgggtcaacctcgccattaacacgaagcagagcaccgtgagcagacagaaccattctgatcatgtttgcggaacggtagaaacgctcggcaattgcctcaaaactatcacctgacaggtacgaatcgataacgttggccagttcagccccttcgattttagtaccacgtttctttttacgcatttcagcggaaacacgctggttatctttccattcctcgataaggcgttccatcgtggagttagacgctacgccgaggatttcgcaagcgcctttcttggttttgccttcctctagccactgaatcgcttccttaaacttttcgtccgggatgctattagcatgaagttttttgcggattgccatgttctttatcctctctcgaatttatgaaactattataatacagatttagcttctaagcaatcgcgattttcatagaacgtagggtcgaaagtaacgtgcatgaattcagatagactcttgtaccccatgttaagttccatgttgatgcgtatagaaaggcgtgtctttcgctgagcctctagccaatcatagatatttggcatctgtgctaagcgaataggtattactctacacaattctatctctttagctttccgtgctttcgtatcgcgtttgggaaacttccttgtttcccagcgggcatcacgcttgctcattacgtactccaagttcgttttgcgcttcatcggccagcgccttctcctcgtccgtcataaactcatacggtacagagataccctcgatagaacagtacgtgcgataccagtctacgatctgctccgtctccatttccttattaatacccatttgggttaagtacatacgggcatatttagggttggcagactgtcccgtcctaataaagaagtccttcttgtgtttcttcagggcttcaataaaggggctaatcgtcacgttagaacacttcttaatatccttccagaatatatcttgaagtttatggaagaactccgcccgcttgtgtggtttcttactaatccacatctccgcatgttcctgtgtgatactcttgatagagtccaggtggaagtacttgaccaacattagcttggcttcgtatgcgtccgcatgacgtggtgcacaccaatccggggtactactcaaaatagcagagactcgttcagcagtatactctgcggccgagctatcaatcttaccccagctttcactgaagatatcgatagttgctccctgatccagcagataataccgcagagtactgataaagttacgggactctagttcacgacgtttaacatacagctgctgagctaattctagccaaccctcatcgatgttatactgctccgaacccgcagagaatccgctggtggacttatcgatgaaatagaagatattcttagctccccggtcgcgcctgattgcctggaagcgcatgtttggcgcctggttagcggtacgagtaataacgaatacgttgtcgaagtaattaaagtcaacaccactcgttactgacggactgcacagtagacaatcaatctgctgttcaattaactcattcgttgtataatccaagatacgacgaatatctatatcagatgtagagtttgagtgaatctctttaacaatcgcacctgtattgtttcttagcgtcaggcctttctcgtttaactcatccggcccacagtcggacaccagaatagatttctctcccatctctagggacgtttggagggcaacccaaatactggattcatcagggaactcatacgcctgagcatccgagagcatcttacgatggtgtttataataagagaccggcttgtcaaaatctatgagagatccatatgcctcaatggtttctgcgctgatatccccgtcagacaggataacgacttttgcagatagcagaatttcacgaagaactgagatacactcacgacgttgtttaacaactggagcaaataacaggtcattcataactgcgtcgcactcatcgataaagataacatcgatctgcccaacaaagtttttaaacttgtggattgagtgaatagtagtagacatacgatcaatggcaccgcgcttgaagtttaacatatctacggacttatcatactgtccggcttcaaacttcttagcgttagatgaaaccagggcacgggtgttagtaactgcaaggaaattacctttcagctgatcacgttctagccacttcgtcactgcggtggttttacccgtacctagagaagccttgataaacgttaaatgcccttccggtggtggacggttgatcttcaaataattcatcccgtctgggctatcagaggtcaacttgtgtacaggaacgcctttaacattcgactcaggaatatctcgcatcgagttgttcacaaacgcttttaatgcctgcttacgaccgttattgaagtaatcctgaagactgcgggaattatccttcgtgttgatataatcggacaaagctgaggtaatttctttctcaagccaggcgaaatcaacaccgtcctccagagctctgtggtacagtttaggaataatacgcagataaacaccatcctctgcttcttccagctctgcaatggtttgttccactttctcagaggctacgcgcttgcctttaatctgattaagtagggatagaaactcttctttaaattccccacgagtggcttcataatctggcatagtattgggcagttcaatcctagcaccgttaactttaaccagacgtggcttaccctccgctttaaacggatcggtaaactgatcccggaaaatcgggtcagcgaaatagtgtagctgtacagatgaataataagctaagtcggcaatatcaaaaccatacttctgccgagagctatcattgagggacgtaaatagaaactttaactgaccctgagtaacgggaatattactctctaatagcatgtgcatacgaatccccggcttaattccagccgaagacgacgcatgggcaataaaccctgcgttaagcgggaacatgtcctcgctgatgctatttaataacttaatgacatgacgtcccatacccacaatgtcaaacctgtcgcatcctccggtatcagagattccatcgacgtccatagcaataatattgctcttatggtcgattttgaagttagtacgtttacgacgcacggccttctctgcaactaagcatgtacctcgtactgctacgagatgtggatcttgagtgagctgaaccatcagctcatacgcttcattaagatttttggggtcaactgtatccactacgttaaatttgtagggcattgaggctggcttaccttctggatgctcgttagaaaactccttcgcaaaaaggtaatcagttgtcttcacttccttccagtttccggaagcgggatcgcgggaaaaacccgcgtgtccttctagaatagaaaacattacgttttctcctatgttgaagaataaagcgatctcgaactatcaaggatagaacagcttaaaagtccactgactcaacaaatttccttatagatggaggggtggtcacttcctcattgctagaactggccgcttcgcacaactcccacacagcatgtaatcgccgctaagctccatgtggttgacccctattcgtcgctattgcgcagaggtacgttgctacttacagcttcacttcttggtcatttcagaccgcggtgctatttgctccacatgactaacgaacaaatatctgagagcctcgcgatgccaacctctcttacccgcattctagatcaattatctataattccgttcggaatcaatttcccaataagccaaacccaaccaagcatgtagcagccggactgttctgtatgctcggaagtgaatgagaggaattatgtcagttttgtaactcacatcatttctctcaacctatgaatatattatataaaaatcgtggcgagattgcaagtaaaatatttaaatacgtggtaggtaactgggtttaagcatagaaaagaccagaggataatcccctggtctaagcgttcaactaggcattccaacccataatattaattgagttagaagaggcattttgtttgccctcacgaagaacctctggagcatacgtccaaggctcatcagctaccaagaaccccggagaaatacctgcccccggttcccggaatgctgcaaaattagaggggtggaacacaacgttgttcaccagaaccattagccccagatccgagaggtcatcccaatcaaagaggatctcataatcctgggccaaactacctttggacaaaccaacacacacgtcatgctggatgatgaagcaaagctcctcgtccctcaacgcggctcgcagcagattctctgctacatcaatcaattccttggggatatccgcccaggagatacgttccattttaggaatactcatttagttaacccttcaacttggaaaccgaagcgacgcagcacctggatccaaccgttaatattttccggagcataataatcttcattacgtccgacccaaatacctgctgaaacacctgtaaccccaaccgggatataggactcacgcagcagacacacgtagcctagtgcaaacaccagccccatctcagtcagatcgccccagtctaggacttcatcttgatcttcgtccataggaacccatagccccaggtgcatgttgtcataatcgaagtagacctccatattatcgcaccacacacgaagatggtccagcagagactcttttacgtccagaggaatttcagcccagggaactagcccaaccccttgattaacaaccttttcattgaccagcatattcttcccccatttggatgaattcgtgccactgctcagagtccgctcgtaaaacctgatagtcgtccgataggtgactcatatcttgtacatcactgcgataacaccaactaccgttgggccataacaggatatcatcgggatggtacataaattttctcctccagccaagcctcaacttgacctatgaaatgtttgttgctaaatacattggcagcagtatcataccaaacggggatcccgcgttcttcgtacaaactctgctccaggtagttaataccgttgttcactacccacaccttagtacctcgactatgggctgggaatagttcccaattaaagtcgattacttggttactagcaccaacaacgattaccagatcctgggttgtcagggtatcaaacaggttgatctgccccatataccacggagcggtttccccgaagaacgtaattgcaggcttaacccactcatacttacggtaatcaaccgcagtgtacccgatatcttccacgatcacatccttacctcggcgatacattatctccgtaaggtagccatgagcatggatcacatcatcatggggaatgccagcacgctctagtagatcatccacgttagtagtaaagttaacgacttgaccagggaagcgctcataccactcagcaattctcaagtgagcaatgttaggctccaccgtacccagctcctgtcgccgcatgttgtagaactcatgggttagctcgtacaggttgcgactaggctcatcatcagatccctcagaaagggcttctaacgggggcatagggtcgttcagatagtgaaaccccttatcgaacgcctgaatattgcatacttcggttagtttgtatttatcccacaggggagtgatggcacccttacggaacgttggcactcaatccagcaccacttacgataatcaatctacgcattacaggaactccatatagtttctcatttcttctttccgcaactgctcagccttttcggacaagcactcagaggttctgggatcgactttatctttccacaagtggttacggcatcgcagaagttttaccacgtcttctcgggaaatagatccgtatgctccagagtccatcataaagtagatacgcttttcatcagttttatggattttcataaatcctccgtttctcaattacaactatcttatcaaaaacggaggtatttagcaagtgatttatttcaaattcatgtgtttgaccctttgcattacttcctgttgcttaccagggttaaagggtctactaccaggactacctaagtacccacaaacgcgacgggtaaccgagatattccccgacccacattgaggacatacaaagccgtgctctccggatacagactctcctagatatccgcactcttcacattcatcaactggaatgttaacccctatgtagtgagatttacttaatccataatcaacaacccactctagtgcagggataaacttacgcatctccggaagttccacaaaggatatattacccccattggcgatggtggtaaaattagcctcatagtcaaacttcacgttaggggcaacttttgtacggacatccaggtggtggctattagtcaggtatcccttatccgttagccagtcgtactcagggtactgttcggcaattttagtattgaacctattgcacagagactcactaggggtagcataaaggctgaatccaagattagtttcctcagcttttttgttacaacggtctttcatgtggttgagaacctgtacagcaaattcaatcgcaggtggggacatggggtcggtatcctcaaacattacttcaaccagctcgttaataccgatatatcccaaagacactgatgccctgccttcaaagatgggccatacaagatcattggctttcaaccgtaccccaaaagctccgtgcatatagagaattggtgcctgtttagcacgcacacgcttcaaccgctcaatagcccaatcgtgggcagccatcgctttatcaatgtattcgtccaacaacttccagaacctatcgaagtatccctcagactctacagcaactagcggcaggttaatggatacaacccctaggttattgcgccccgcagtctccccggactcaatagctgaaaggaaagaccgacaacccatagggaacttaaaatcacctgtaacagccgttactctttcataactcacgtaatccgggtacatcctcttagaagtgcaggtgagcgccagctgtttgatatcgtagttgggatcgctgggagatttattaagcccctctttaactgcgaaaataagtttaggaaatacagcagtatgccctgaagcacccaggcctcttatacgaacttccagcatagctttctgcaacatgcgtgcctcccaggattctcctagaccaaacccaaatgtcacaaatggctgctgaccattagagttgaacaacgtattaacttcgtactctagcccctggcacgcatcatatacttctttttctgtcatttcagtagcatacactgctgccttcttactatcgtgaagccaacgctggccaatagctaagtgcttatcataggacttacggacatacggggcaaagacctcgtcaatacgatcgatagacgtacccccatactgacacgagcttacctgggcaataacttgggcagttactgcagctgcagtagagatagattttggagtttcaatctctgctccaccaattttagttccattcttaaacatccccgctaaatctaccaggcagcagttagtatacccctgcgctcggtagtccatatcgtgaatgtgtatctctcctctattatgagccgccaataggtatgctggaagctcctgtgctaccacatacttagagacttccccagctatcatgtccctctgtgtagggaattgctcgcttgccttattggcattattaaacataaggtcttcttcaccctcgttatcaaggatactatagatattatcaatcaggtctaattcgttcatatattcctccagttaggcatatattataccaaatagacacaactatgtcaaccttattttattataatcaacagtaacttgatctggatcatcaaaacaataaaaactggaaaattttatttgcttattcaccctattttatattattcgtgtgcgcccgcgcatcgcgcgaataaaggaaaggatccgtcctccatatcatcctagaaaatttcagttgcaatccacgccaaaacttggtatactggtattctaaattgataaacatggtcgaaatttgaccctctgtagacctctaaggagatcgcaatgagaaaagcagcacgtcgtaaggagtcgcgccgtaacggtagcgcaaaacgtgaacgtcacgaaaacgtcatccccgttgattttgaagcacgggaacgttttcaaccaaccgcaaaagaactcaagccgaagaacgctgagcaaaagcactatattagcaccatccgtaactttacggtgacagttggtattggagaagcaggtacgggtaaaacgtttatcccatctgttctcgctgctcaagagttagcaacgcctggttctgtgtacgagaagttcatcctagtccgtccgaacgaacctcttggtaaatccctagggatgttgccaggagatctgaacgagaagatggcaccgtggttagaaccaatcgctgacggcttcaagtgggccttaggggaacgttcttatcaggggctggttgaacgcaaggcaatccaataccttgctatcgaacatgcacgcggtcgtaccttcaacaattcttatgtaattgttgacgaagctcaaaatatctccgtagaagcaatgaagtgtattctaacccgcgtaggtcaggattgcaaattagtaatctgtggcgacgtagcgcagaaagacattaaatccgactctggtctgcaactgatcatggatatctacgatcagtacgaacatgtgcctttctccttagtagagttgcatgataacgtgcgttccgctgaatccaaagcattccaggcaatctttaacgatatgggaatctaatatggttactgaactgatcattggttatggtgagggtattacctctgaagaaaactggggctttgtaggcttcggtgaaggtatcacttctcacgacgaacgtcctgacctctaactctaggagcgcgtatgaacaacgtatttacactgaacaacttccgcactcgtaaaacgaaagtgcatccagtatccctggcaacagtcaataaatacaatgctaactatcctgaggatgagcggcgacaccatgccgctttcaagatagcaaacgaatttcctaaccaacccctcggtactaaagagttagttagtcgaatgaaaaaattacacttttattaaagtagaccgacacacaggcagcctcgaaaggggttgcctgtttttgtctgtaaaatctcatttgcaaaatggccgaaaacaaagtagaatatcttttaaatcctgacaacttccaaaaggagttaccaatgacccaacgtattgaatacgttatcaagcgtgacggtacaaaagaaccgttcatggcccagaagctgaatgactgggcaaaatacatcggaatccgaagcgatgttccgtggtctccggtagcggtagccgcagttaagaacctgccgaaaggtgatgtacactcagacgatctgcaaacaatgctgattaagtctgccgaatcaatgatcgagcgtgatcatcgttacgaccgattcgccctagagctgcgtttagcccagctccgtaagaacctgtttgattcttacaccccgccgtctctgcgtttcttccacgaccacatggtagagctgggagcgtgggaagatatgagcggctggatctctgacgaccagttcgaagctctaaacgaagttatcgaccacagccgtgacgaactattcactaatgctggtctgaagcagttcatggataaatactctagacgtaatatctatacggaagagatctatgaaactccgcagtttgcctacatgggtatggcaatggcaatgctttctcaacctcactggagtatgctcgatgcaatcgacctttataacgcgctgtcgctacagaaaatcaacgtcccaactccgccgctcgtgggccttcggagtgctgacaggggcttcgcttcttgctgtcttgttgatggtactgacaccctggactccattgacgcagcagagcacgtcgtcttcaaaatggtcgctgcccgagcagggatcggctatcatcttgagagtagatcaattgctgatccggtgcgaaaaggcgcgttcccacactctggaaaactgccatattatcgacacatcgaccgctccgtaaaagctaacactcagcagtcccgtggcggttctgcaaccgtttacactgcgttcttcgatccggaaatcattcaggtaatggaagctaagagcaaccgttcccctgatgaaaagaaaatcgataagatggactacaacctgaagtttaacagtattctcctgaaacgcttcctgcgtaaagagaacatcacactgatgagcttcctgtacgctccagaagtatacgcagcattcgactctggtgatgtagcagaatttgaacgcctgtacatcgcagccgaaaaacgtctagcgggcgttaccaaacgtggtttcaagggtgaagttctccctgtagccccagtgattcctgccgcagaactgattgagttctggaaaactgtacgtatggaaactggccgcctgtacactatggacgctggtgaagtgaaccgcaacagccgttacaaagatccggtgcgtatgtccaacctttgtgttgagattgtacagccaacgttcccgatccctcacgtagtagatctgtaccgtacagacgaagaactggataaaatggatgtttcagagtatggggaagtatctctgtgcaacttaggcgggttcgccctaggtcgtatcaaaactctggaagagtgggagaagatctcttacatcctgttgaagttcgttgataccatcatcgagattcagcactatccgttcccagctatgaagtacacggcattacgccgccgtaacgtaggtattgggctgatgaacgccgcaggagcgatggccgctgaaggcctggcattcgaaggcgaagaagcccgtaactggattcaccgtgaagcagagaaggcatcattcttccttcataaagcgtctgtacgtctggcaaaagagatcggcccatgtgaatggttccatcgtactcacacttctgatggtacactgttaatcgatacttacaagaagactgtggatgacctggtttccgtaggtctggaaatggactgggagagcctccgtgaagagatcaaaactcacggtatgcgcaactctgttctgacggcaagtatgccgggagagtccagctctgttctgattggtgttaccaacgcagtagagcctcctcgcagtgcggtaactatcaagacttcgggcgttaacaaagtaattactgtagctccgggtctagacgattgggacaccatgcagtcctataagtatgcgttcgatattgaccgtactgagcacattaagtggttagcagttctgcagaagttcacggatcaggctattagtgccaacctgtactacgactttaacaaatatcctggaggtattattccgggtactgagattatcaaagatctccttaactccactaaatatgggattaagaacctctactacgcaaactttgacgtagataccggaggctctgcagcagagcagggttgttccagtggcggttgtactctgtaattaagctcgatccaaccgaaagcaaaattttatttgcaagtaggttggattttttgttataatattcgtatattaaatgagagaggaaattaaacaatggcaacagtatttaaccgcgaatgggatcacactgagtctaaactattcctgggccaagacctgggaatcgccgactatgtaaacgttcgctatcctcgtttagaggaacttgcattactgcaacgctcgcagttctgggttgagactgagatctccctggaagccgataagaaacaatggcctaatctgccacaacatattaaaaacaaaaccctgctgaacttagcctggcaaacccaagccgactccattatcacccgtgctccggaagatgccattctgaaactggtatctcgccctgaactggaaggtatgcttattcagtggagctactttgagaatattcatagccgtgcgtattccaacattattcgtaacgttctccctaatccgggtgagttcattgcaaccgtacaggctaacgacgaagcattcgcacgtctagcactgccggtttctgttattgatgagttggccgaaattgccgacatttggctggacgctagagccaatctggaaatcgctgagaaggaaggtactctggaatacaccgaagaggcagacttcttagcacttactgaacaagtacagcagaagattctggagttctactacgctgtatacgctctagaagccattatgttctacgcgtcgtttgcgtgcacctttgctctggcagaaaacgatatcctaaccggtattgcaaagaacttacagctgatcgctaaagatgaggcactccataccgttatggctatggaagttctccgtattcttcaaaatggggaaattcccccacatgtagtggcagcagctcaggctaacgccccgaagatcctgcgcagtattctggagacagaaattaactgggcgcattatattttcccggaaggcgaagatattccaggcctgaacgccgatttgctggtagagtacctgtactacaacgcacgcctggcatttatggcgatcaacattccgtggccggaagatctcccggtaattatggaagacccgattggctggatgaaaggttggctgaacaccaagaaccagcaagtagctccgcaagaagcacagattaccaactatcgtgttggtgcaacctctcaggctaacccggacgatctgtctgatgaatttggagagttcctgtaatgattacagctttatacgcaatgcgagttgacgccgccttcgggatttttaatccggctacaatggatgcctacggggaacttccctggggctccattcccgaggagctagaacagttctacagaatcctggatacctatcaggttgttatagtgggccataatacctacgaaacagcccctccacgactgaaaaaggcactggagaagaaatccatggtgtacgtagtaggttctaaggctccagttctgataaaaaaccctccccgtaatgtgcggtttattacccacttgggttccaaaattcgggacttctgtaatgaagttgaggtagtctgcataggagggaaagctctgctagaaaccctagcaactatgggctgtctggatgcgatttatcgctccaccatttatcctaaggccggtacagtaccaagcctagaccacatcatgtatctggaacacccgatacttacgtccactcctccggatgctgtagtaactcatatagcttctggggaaaatgagcgctatcgttttgttatggaaggagtctatctgtgattcactatattaatgaaggcaaacgcattcttgaagaaggtgtatggctggagaaccctcgaacgggggttcgttgtttaaccgtaatagggtcaaactttgaatatgatgtactcggaaagaaattcccacttatcacaactcgtaaagcgtatgctcttcaggccatcatggagcttatcggatatctgcgaggatatgattccgcagagcaattccgtgctatcggctgcaatacgtggaacgctaacgccaacgaaaacgaggcgtggttggtcaaccctaacagaaagggaaccgacgatatgggtagagtctatggagtacagggcagaacgtggcttcgaccggatggttcccactttgaccaactctataagatctatgagaatttacgacgaggcattgatgaccgcggagagattctcaccttctggaaccctggcgaatttgatcaaggatgcttacgaccgtgcatgcatacccaccagttctcgctgctcaatggaaatctgtatctcgactccttccagagatccaatgacttcctattgggacaagcctttaacatggtccaatgctacacgtttcttgcgcttatggcccagatcacagggaaccgggcaatcagagcaaaccaacgtatagtaaatatgcacatctacgagaatcagtacaaggttctcatggaacatgggcaatttgaccgcaaacctttcccggctcctcgtctagagatcaacccggagataaaaaccctagaggacgtactcacctgggtttctaaggacgactttaaaatcgtggggtataagtctcatgaccctattgcatatccgttcactgcgtgaggacttatgggattatttaacagacgccccaaaataaccttctccgaaagggaggagtctcagctgaagtttctggttcaatcctcgggattacacatagatgttatcctagggatggtaaagtacaagggcatggacgcactaatgcgtcagtttgcccctaaaccacctaaagaaaaccctccagccaagcgggactataacagtaatttactggttcctccagctaaattactataactaaggtggccttcgggccacttatattaaaaattcatttgcaaaccacgtgaatttctaatataatagattcataaatttgagagaggaaataaatatgtcttttactgatgcaaaagcaatggcagctaaagccaaaaggtctaacgatatggcagttatagcagctcgcagatctattatatcaaatattgatggatcagcttcttcaggtaaaacagaagtagattcttacgcattgaatggcctgcctatcgccgcacggtctcagattatggaagacctaaaggacgcgggctatgaagtaaaagtaaatcatccgtttgaccaacgcgatactgaatcaattaccatttcctgggggcacgcataatgtttcatgtttatactgatggtggttgccgcggtaatacccgtggggtagacaacgttggtgcttgggctatggtagtttacaactccagcgaagagcaaatcggcaccaagtctgctcccaaacgcaacacaactaacaacgagatggagcttcaagcagtcctagaggctctgctatggtctaacaaaaaccctggccgaccaatgacaatctatctggactcaacctacgttaagaatggttgtgagtcctgggtttggggctgggaacgtaaaggctggaagaaggcagatggtgatacacctctgaacttagaccagtggaagtggattatcgacgaactcaagaagtatcgtctaaaccacaatgagatcccaactttcgttaaggttaagggccactctggtgtagaaggtaatgaggccgcagataacctgctaaatgttcgaatgaccgaactggaaatggaggatatgtgatgttggagaatttacgccgcctagttagtgaaatgaaatatgaagtgctcctgatggagcctggtgtggatcgagtagtaatgaaattgcgaatcgcacgtatggaagcccaaatctttgaagcggagtggaaagctctgaggggtggagatgaattataatggcaccagatttgagggatttgttcccaaacgtaccacagtaccagctcgatctctacgccgcgtttctggaagcgtcaaaatcggggaaccctctacgcgtctaccgccaagaccgcaggcacgggaaatcctggatcctgagatggctgaaagagaacgagccgctcttaaagaaattgagcgaaagaaactctgtacagcaccggcatacaacaaaggtgggtaccagtacatcagctcagaagagcaggcaaaacatatcgggcggtaacagatacgagttcatcatcttcgatgatcttgtagatgaaaatgaaaaaacgcagttgctaaacgctaaaaattaacgtataatagattcataaattaacgaaaccaatcaaaacaaaggaaataaatcatggctaagcagacctctaaaaaagcagtagaaaccaaagttgcaacttttcccaaaactgaagcgaatcgcaaagcacgtctggagcgtcatctgcgtaaacatccggctgatactcaagcagcatcagctgtaggcaaaccggccccgcgtcgtaagaaaccggtaactaagggttctacctccggctacgtctccaagatcgtcggttggagtacgccggataaggcagacaccaaagaagtcctgcgcaagacccagggccgtttcggtagcgtcaagccgaatatcttcggttgcgaatacagccgtgagaatgttcgcgctctgtgctacggcgtaggtattaaatttacgggcaaggcaaataagccccgtaatcaaaaacgcaaaccagctaagaaggcataatgcgaaattttgtagctaaaaacgatttcaatcgtgcagcgacacataagtcggccctagattattctagggtcaactcccgggaactgatggattcgtgctacgaagaactcgaagattgggcggctgactggccgtcgatggaagaaaactgggatgtgtccgaagatatgactaagccaccaccggaggtggcttctaaatgtgataacacatctagaagcaactttaataacaaaggaaacaatatgcaaaacttacaagaccgctggatctctgtttgtgatatcgaatccctgggaactccgggagattgcaagagcacctttatcgctatgccgtttttcgctttcgtactgatgaaagatctatcgttagatccgtatatcgttctaggcactcctaacgttgcccagcagttggccctcggtgctaaagtctccgccggaactattgcattctggatgaatgaggctcgtgctggtagtgctccgtcgctgtccattattgaagctctgaacgctaaagacggtgagtctactgttctggtctgcaatccgactcatgaatcaccggtatccaagcatacgttcatggatctgatctgcccgttcgtagaggcaaaacaggtaatcgaaggcattatcgatgagcaaggtatcgacactcgttccctgcgccactacggtaatggcccgcagttcgatatgtctatttacgaaacagtggcggctcaggctaatgtcttctctccgtctgatcctgcaatcgttccgtggaaattctgggatatctccagcgcccgtaacccgcgtgactatttcgaggctctcggaggagactggaaagcattggtacgttgtgctgaaatctacgcacacgacgtaatcgagcgttacaacctgattcctgagggggtctatccgtcgaaacatgatccggtgtttgacgccctggtagaagcgtactgtattaaaactatcgaatcgaaattgaaaatttgatttgactaaatggctgatttcttgatatactattattcttgaatcaaagagtaaaggagaaataatgaaagcagccattctaatgatctccatcctcactagcttccatgcgcaggcaaagattgatgcgcatgagatagagtgcatagctaaaaatgcgtactttgaagctagaggggaaggagttaaaggaatgaccgcagttgcacaagtaacgaaaaatcgtgttaactatggaaaattcccgtccacatattgtaaagtagtctatcaaccagggcagttcagctgggttggtaagaagaaacataaactcgatcgtaaagacgaagagtggaaacaagctaaagagatagctagactagtttactatatggatcttccagtagatccgacgaagggagctttgtactttcacagtaaagatactaaaccttactggacaaaagacaaggacttcaaaagaacaagtaaaattggcaaccatgtgttctataaattaaaatctcagttgcctaatgcttaaaaagttgatataatagtttcataaattagagagaacagcgggccgattacgctgaacttgttttaatgtaagactcgtcgagcattaagattcgttgaatagaatcggtgagttaagagtgatcacctgacaaagttcgtgcatccagtccggataccggccagggagcgtattggacgggcgtaggttagagatctcttgtaaaactcgggagctgtcccggagtctcgtaaactcttctcctgatttatagaaaatggtggaatctcactttaacctgttcgaccagaatgaagcatggtgcgtggcctgccggagaggtggggagctgagcctgagaaactcgtatagctcccacactgacctgcctaggccgcaaattggagacatgtgtatagcgtctggtgctagttattgccaccatagtggggtgtcgaaatcacttatgtagcaacactgccgtcctaagttaattggtagacttctgcacgcgggggagctatccccagatgcggaaagtgcaggttcgaatcctgcggtcggaaagagttagataactgatggttctattggcgaaccactcgctgctggagtacctcctcccctcccagggaaagacttgggagactcgcgggaacgaaacagctaaaccacgaaggactaggatgctgatttggctacccttacctgatatatgcccaaatcaaaagaagaactttaggcggtagcctagatagtgaagtttttcctccacgaggagtcgtttttcaagctatcaaaacttcacatcgaaaattcggaggtgtgattttaacagaccgcgtggaggatggctctccagaagtgccaaagttagtccttaaatacggcatgatgatcgtatgaactttggcgaggtgggatctcgcctgattctaagtgggaaagagtattcggatagccgttcgtacaaacggtggctccgagacctaagtgggacacggttgagtatacagctccgcggaagctcgtataccctgtgtaagcatgtgacaatggagtcatgaccggagtcaccccgagcgaaagcataaccactatttatagcacccttacacaggctagaagtgcccctgtttggagtgtgccctcgcctagaccgcattagccgacggatatccgttggccgggatctggcaaggtatattagtcaccttgactataactggaagatacgtctgacagaagggccgcatagcttaaacaggggaaggcccctacctactggcggtatctttaagagctttcacgagagttcttaaagatactaattgacgaggtctatatgaacgatttaagtatgttaactaagatacgctctgatattgagtctatggtctctcgtcgtagtgagctgactaaggctaaacagatcatcagcggtggtacacagaaacgcttcacattgcaagccggggatattaagtttgacctatgtggcagccagactcgagattacactttcgaaatgaaaccgtgttacgatatggtgaagctggggcttatcaaagctctagacaaacaaatagatcagtgtacggacgcaatcaaaaccctaaacgtccagttcgccgctgaatgcgatcgtctcaaaaactctatcaaggtataataatggtggcatctgtgcatactcctccgtatgaacgtccagcacctaatctgacacctgaacagaaacagctaatcgccaggcgcactctagagtttaaagagtcgctgcataagagcgttggccggtattctgaacaggttcatgatctggttgtcaaaacacttaaactttattaatgcttccttagctcagaggatagagcaacggtcttctaaaccgtgggtcacaggttcgaatcctgtagggagtaccactttaatcgctgcccacacgtaatattcagtgggcagcggcagaaagcccgcagggcgcagattaagattgattctacaaaatttttcttgcaattttgtcagaaattttgtataatagttctttaaatcaaagagaaagtagaggataaaatggcttacaaaattgaatatttaaagaaaggggttctcactgagctggttatcgatgcgaacatggctcgcaacgagggcactaaatccgtattctataaagacggtagcgtagctcgtatgatcaataccgaagacattcaggatctgtacgtgatctccgacgaagaagcaggtttcgtaaaagatcctgagccggctgaagatactccaactgaagacactccggtagcggataccactactgaagaacctccggtggaaggcactccggaagatgaagcagcagtataaataactaagggctagaaatagcccttctccttgggccggtagcttaaagttaaagcagtggcctcataagccaacgagtgggagttagagtctcccctggcccaccaatttcataacaggagactaaaatgtctactaaaaacgcaatcgtatccttcgtggatgacagtggtatcgtcctagagtccacagtaacagatatcagtcctaaacgtctgctccatcgtgatggggatatcctggaaatccttaataaacggtctgagactatgctggtcattcctgtaaatcgtcttctctcgattaaaatcgtgtgggaggactaatggacgctcaattacaaacccagtactatatgcttttaggcatgttagaggatgctggcccgacagtcagagggcactatgagcgtcacaaagcagcttttgaagccctactaaaagaagttaatgagaacgaaggtggtaaaggctctgactcctatgccgcattcattatcgcgctacaagttttcctaatcaatcaactcaagtaataggctaaatatgctgaatattaaacgtaaaggttttttctacaagtggcttaatttctcttccgcgtctttcacctaccggctgaacgacaacagagtcaccttgtgtagcctattttggcactcagtgtggtatttcctgctacagattggcgtaactgctattgctgtactcttctccttggggatgggaagtatcttatctacgttcttgggtctcacctttgagctgggaattactccctggtacatgcttgtagggttaagtctagcaggactatctacgataatagcgattctgctggcgatagctgggatcggctgggcctgcgctaagataggggatcggatccaggaatggaacgcgagtaaatcctttgaaagggcacagaaagagtataatgctcgcgatgaagagctccgcttcggtaatatctaccagaagatgcgaatctataagaaggacaaactttgtccgctcattcgtgtagaccacggcgagtagtttgcatagtgacctgcgttgccgggtcactaccaaaatacttgaaaaattcaattgctaaatgctctagaatttgagataatatttatattgaaagggaatagccaagtggttacggcatcggcctttgactccgagatcggtaggttcaactcctccttcccttgccaaatttaaaatgctcctgtcgtctaagctggttaggacaccactctttcacagtgggaacacgggttcgaaccccgttgggagtaccaaatttactgaaaaattcagttgctaaatgcttaacaaattgatataatatttatatagtttgttaaggaattaatctgatactgagccggaaccaaaaaacacgcttgcagcttgctcggtcattgtactgagggttcgcaagaatagcggagtggctctccgaaacgcctggtaagcgtagagtgtatcgtatttgtgaagagcgggtatcctcgcatggctaattgcttagggtattacgcgcaccggattaattgccttaacaaattattgggggatgggtctgctgggagtggacaccgcacttgcaatgcgggaatcagaacggttcaaatccgttatcctccaccaaacaaatggggatgtggcgaaattggcagccgcgctagatttaggttctagtggtgaaatatccgtgtgggttcgaccccctccatccctaccaaataacgggagttcgtgatgaacatagaaatcatgcagttggatcgtaagaaaaatgagttccgtaaggtccatacctttccgagtaaagaagctctagagtttcatattaagtgtatgggactggtgctaccggaaagcgagatcttcgacttagcatgtgctaacggagttctgtacgtctgggaaatcacgtatcatgctgatcctgatgaactccgtaaagaagtagagcaaatactaactggagagtagtgctcatgggagcaagctgacttgaaatcagtcgccatcggaaacggtgagggttcgattcctttattctccgccaaacaacaggaaagctggtgaaatggtagccacgcatcactgctaatgatgagtccgcaagggcatgaaggttcaagtccttcgctttccgccaaacaatggcccgacgagtaacggttgcccctttctagagaattttctgggcgaaaatccagaagtaatcaactagttgtaagtgggaagagtttcttagggccgccaaatttgagtatcattggtattgtaggagtcgtacgctgggactacgtagtacactgagtgtcctatgcccagtacgcggtctaaccaaatacggtgtgcgatgtgcattttatttgtggaggtctgatcagccctcgatggtactcaaatttgggatattatcataactggataatgacctcgattgtggatcgagtctatcttggttcgaatccaagatatccctccagattactgcaccattagtttaatggatagaatatagagctacgaactctatggttgaggttcgattcctcgatggtgtaccataaaatctctgctgagagtgacgaggttagccctctgggtcacatccctcttctagccgcctcccataaatgcaagcatttatgttctggccctagacacaacgttgtactcagcagagtgcgcataattggggtatagctcagtaggtagagcggaggtctctgaagccttaggtcacaagttcgattcttgttgcccctgccaattgcaccgtagaggagaggccgtcctcgccagtctcataagctggagatcgcaagttcgaatcttgccggagcatccaattctaggagaagatgatgagaatctctttcacagaacgagtactaggtactggagtaatgctaatcacttcctgggatggagatagctggtgtaacgtgacaggcttacgtaagtcagaacaaacacccgagaatatcgctaaaatcaagaaacgaatggcagaagctgctagtcgtcctggagcacctcgtaatggtaaacgttgaggtaactatgactcgctatcaaggtatgctaattaatacccacacaaaagagattgtattcttggcaccggcttttcacgacacctacaatgaagccgaggaagacgctaggatcgctaaaatacacccggacgaggaaatctgcgtccgtcagcaagaacaataatgcttcaatagctcagttggtagagcaaacgaccgataatcgttaggtcactggttcgagtccagttcggagtaccaatttttgccccctataggatatttcatcggaatatcctccagcgatggtacgtagtatagtacttacctgttaagcctagacaaagttactttgtgggcaaaataggtatagataggagaagaatagtagcgtaagattcttgaggcaaattctttaggtcagttggcagagatggtttatgcactcgcttcatacgtgagactacagtggttcgagtccactattgaccaccaaatacttgcttagctcaatcgggagagcatcgtctttacacggcgagggtagctggttcgaaaccagcagcaagtaccaatttacagtgagacttcggtcagggccgtcaaacgtccgagaagctgtaatttctgatggggatgatcccagattcgtaagaataccccatccttaccttcacaggttttagcgcaatgctgagtaaaagtctagggaatcgactccatgccatccaggagtataaatggcgaatctagggacttagacggtcattgccctagcgcgttgatgccgtgccggaatcggtatacggggcttcctaaagggcgtaagcagaacatccactctgcataagatacccgaaaacgaggctgagataaatggtctatcttgtgaaggttcgatcccttccggggttagcgtgtagtggggctaatcaatccccacgttaaacgttcaagttaagatttgttagttgcagaagcggggaggctatcaaccttcagtccctgaaagctctcagcgcttggaactctttcgtccgtaaggaatagatcccctttcgctttgactcgcaaacttcaaaccaagtgtaactaacagctgcaagcctggattaccgctctccggagcggataattcaaaaatttatttgctaaacgctcttatttactgtataatagttacataaattaatgagaggagttagcaaatggaaaagattactgcaactggtattgaatctgcactggtggttgattgggccggatgggacggagatcacgaatggatggtcttttatagctgtacgcttcagccagaactatggactaggcttaccgatgagcatgctatgccctacggtatcatagatgtagaaattgagattaacaaactggttggcaccattatggtgcatcgagccgaaggcgatcacaaggaaatcttccgtaaaagcattaaactggtagtttctaccggtgactttatttaacaattaactgaggaaatactatgtacacacgtcctactaatggaaattctgctgtagtccgcctgatgattgttcaggacaacctgtccaacaacatcgagtctctagaccgtcgtattgaggagtatcgcactgagatgctgtctctgatgcgcgaacgtgaggccaagatcgaagagcagctagaggtttgcgaagctatcgaccgcctggttgacggaaccgcagtatttatggcggaagctcccgcagagcctaccttcaccccggtagcaccagctgacatgcagtatgctattctgcctttccatctggaagaagaagatggcgaaggcccgtcgctggaagacgttgttcgcttcctgcttgcctccggtttcccgaacggaggtcgttaatggattttatcgttgtttgcggagcgaatactgactgcttcgagctgttaaacgacgccctagacaaggttgatgaacacatgcaggaaggcagaactcctacattcattgacctgtctcaaggtaaaacttacttctacccgtctcttgacgtagagcctacagttctacctatcttcatgcactccctctcgtgggacgaagaagacgattaatgaaaaaattcatttgcctagtactctgaaatttagtataatatttatattgaaacgaaagaggaaaagcaaatggaagatgaagttaaattgtacatttgttcagattgcggtgagttaagtgaatgtcattgggagtgtccgacttgtgagtcagacgacttaatggaatacgaaccggaataacaaattaagcggctatggtgttcagcggtcaacataccggcctgtcacgtcggagccacgggttcgaatcccgttagccgcgccaaattctctctgggctaagagatatgaccgtctagaggtatcctcggacacaagggtcagccctagacacaataagttagcaaatatctcgtttcgacgaggtatttgaagaggttcttacgagagcttcttcaaatacgggggaatattctgtaagtggtagcagagcggtctgtaaaatcgttgccattgcggctcgggtggttcgactccatcttcccccaccaattttgacaatcaaagagatccgggttcgaatcccgcgtacgcaacaggcggcataaaggccttgtagcttaaatggacaaaagcgctttggttgttaaatctatttgggagagaagcagtaagtggtataggcggtcgcctgttaagcgaatgacagtgagttcgaatctcacctctcccgccaattttactgaaaaggttatttaattaacctaggcacgcgtaggaatactgccaccgcaattgaaagatgtggcccggtttggagaggtatgccgctacacgctacggtgctaactccgtctaggtgaaaatcctagtcagtaatacagtattagggtaagaacagcgacttaggttgcagtgaagcgttagcaatcggtggaactccggtgcgccctaattaaacaatgcatcattggccgagtgactaggcagaggcttgcaaaccctcgaagcatggttaaaatccatgatggtgctccaattaccagaggtactcatgattaagtataaggcgtttgtaacaagagagtcccaaacaggagattcaagtattaaattcgaaggtacaacgttacatgatacatttgaagccgctttaacagaggcggaaacccatatagtatcgaaaagctgctatgctcatgtatgggaagtaaacactattttagatcgctagctcaatggttagagcactcgccttttaagcgataggttccgggttcgagtcccgggcggtctaccacattatgggacttcagctaatcggctaagcatcatagatagcggggaatcccggtctgtgaggggagtaacacgtagtctcccaagttccaccaaacatcagagcagcgtgatgtactgcaaagacccaaagaccggggtggacttcttgattcaaaggagcaggcacgaattacgcaactgtagctcagcgaggtgagagcactggtttgaaagtccaggggtcgttcgttcaaatcgaaccggttgcaccaaattaatagtatcaatagcttatggagctgaatagtcctaaagctcacggtaaagcagctggccgttagtgagcagacttggaaacgtctggtgatctctaggttagccggtgcgttggttcgaatccaactgatacttccaaatcccaagtagcccgttacaggctctctgattaaactcagacaagcaggtaatgggtgacaggataaaataagccactgatttccggccgtttgacgtggtaaagtcctccagtcaagaagaatttctgcgtgcagaaatcactgaaagcaatggggcagacaacttgagatagattgcctataacgtctcaagtagtggcattgacttagggtggcattttcccgaaagttcgaaaaattcatttgctaaacgctcttatttataatataatatttatataaattaatgagagggcttacctaatgaatcaaaaaattcttatgcgatataatccacgagctttatggttccgctgggaagtgattgtatcgtaccagatacgagtgcgtaacggtgatcctgagaacaacattatcgtgctggagacattctctaatagagatgcggcagttaagttcctgaacaccatcgacaatactttaatcaaggtatattaataatggatatctttactactcctgctatcaacttggtcggtgtcggcctattccaggcaacggtctatcgtattgatgatagcactgacgttgtaacgttcattgtaccggagttcttccttgagaagttctttgaagagtttgagcaattccgtgaagagcatgatgcttactccaatatggaagatctagcagcgatgttcccaactgtatacggctacatctttgaaggcaatgatctgcttttggataagtcagagctggtggaactcaactggggcattagctttgaagtgggctctccgttcccgcggtatttccaaggtctggagattcgataatgggcggctactctaatttcatcgagaattacattaattccgtagattcctggaatcaggaaactctagtggtagtgcttaaagagagattcaatatctctactctggaagccctagaggctatagaagcctacttggataacgattaacacccacttggtccaatctggtagaggcatgaggcttaagacttcagggttcccggttcgagtccgggagtgggtaccaaattatggggcacgactgatggggaagtcggcctggctagggttgagatacggttcgattccgtaggcaaatggtctcgtaattccgcacaggtgatggaaggttcgagtccttctcccataactatacaaattccccttagctcagtctggcagagcgggcgctttgggagcgtcaggtcaagtgttcaaatcacttaggggagaccaatcttgcctcaatagctcagccgggagagcaaccgccttgtaagcggtaggtcgtgggttcgattcctacttggggcaccattttcgctggttatggttacagtgtgattaagtttacattgtcattaaattccggttcaattccggaagccagcaaccctaaaaggtaagcatatgaggattctttccatagaagatgttatgtgtgacagatgctacggctccatattctctggtggctgtagttgtaagtaatctatctaatgaccttctgtagatgtaaaataaatatgaagggtcgatgctcgcggctaccgacagatcgtaatgatcaagtagtagtctgaggtgaagagactagcccattaattccgcgactaactgtacgggttacagcgtccgccttccaagcggtactgagtggggttcgattccccctagtcgctccaaattcggtaaaatgaccgtcccctgacgttacggggaattaaacaaggaactgggagccggtaaggccattttatcgatactacttgagaggtacaacaatgaaagcctttgatgcagaactagtgttctcactcttagctgagatggaagcctgcgtagatcgtgtacgtgcgctgcgtcttagtatgtttagctcttaaattatttgctgttctagagccaatgtagtccggggtgccgacgtctgcctggaactcgactctaggatagtcaggacgtcacttaacagccagagatggcaaactataggagaagcaaatgttaacagttaaggtaatgtcacctaacggtggcgaagaaattcacgatggttcaagcgttgggtttaatcctaagcagaagagcatctctattgctggtcttgatcagcatatcttcctgaaagaagatgaggtagcctacgttatgaatcagaatggtaagacagtatccgtctaccacggtagctaattttattccccgagtgttactggacagcacgccggtctccaaaaccgtgcagtaggagttcgagtctcctggggtttgccagtttaaaggagtgatcatgatcacttatagcaccaattttatggggccagtctccaacaattggtacatccgtatgggtattccgtatacggaagtaaccgagccgaatcgttttgcagatggcgggcaactaactcgaaaagtatttgccaaacgatatgccggtggtcgcattgacgttcgtggtactgatgactatttcggccaggaaatcggtgttccgattatggaggccgagtcttggaatgaactacagcagtttctctggacattctcgtccgataaggttctgacattggagcaaattgtacaggctctagaggacgagacaggttttcgcattgtttggtttaaggagccagcatgtacatagatcgtaaccaactgttcaagttcctagagcttgaccttcgttggcctctatcagtcaatccgggacgagctactggcaagacgttcgaggctattaatacagcctatgagtttgcagtatttaaaggtattcaagcagtatacgtagcatccggtgtccgtgaaatggcacgcctagagaagaagtataacgagcttcaacctcatgttaaaattacaacgtatagcatgttagaaccctaccgtataggtcgtcgattcagctgcatcatgtttgacgaacctagcttggctattaagtacggcgtaaacgcttacgtggttcgtatagccagagaaaaccagtgtcctgtaattatttttggagagtaaagtggaacaagaatttcaagtcttcgtagacgcctctaagagagttttattcatacaagccaccgatgaaggtcatggcctgcaactttccttcgactctctggagcaaataaaccagattgttctgagggcacaaaaatcattagaaaagaacactgaggcacctcctgacctctaaacaaaagccccttgtctctttgagcgaggggctttttctttataaattcacttgcaaaaatgccaattttgccgtataatagatttataaattgatgagagagatttccaagatgaaagtaacaatggaaaacacagaagagtttattgctatctgtactgcgtatgcagatacgcttccacctgagggtatggacgaccatacaatgcagttagtggcggatatctacagattagcagagttagctaaagaacaacacaacaggctggtgtacgtcaaagaacgcctcgaaatgatggataaggagtaatcaatgaacgaactcaatgaactgaatgaattgcattacgctgaacgtgctattgacgagctggatttcgctggtggttattatacccgacacgtcaacgcaatgaccgccgaagggcttaatagtaagtctgcgattgctgcggagttagcagttcgggactttgttattgatagtctccagaagactattagcaacttgagcgaaaacaacaaagctgctctggaagccctggataagctgtccaaccatcttctcgcattggggatcaaataatgaataagcaatctctacgtggtatccgagtatttcgctctagccttgttgattccttctatatctggggcaaggcaactcgacgcactgttgagcaagcactagacggtacgttctatgattggcgagaaaaagagcgaaaccccgtattcagccgcccagggctgtatcacgatcgtgtatctaagacagcgtggtacgaaattgaagtaactcctggcgttatcagagcgttctatacggattgggagcacgaaaagtgggtttgggacaatcagattgctcccggtgatcgtattatgaactatgccgaatataaagaaatgaagcgcatgttcgagctatacgatgttcctaggctgtctcgcccggctatcttcattgctagccaagagtactggcatactgttcgtatgaagcgtgattttaacaagcatcacctgcgctatgagaaagaacacggcacactgcgggaacgtgtggccaagagaaaagccgaactgcgtgaaaaacgcctggagaagaaatatggtgaaagctagtctcttacgcttcactcctggagttggcctccagtataaaattgttgggggccacaagttccaatacttcaccccgggtaagctctacttcgtcgagctacacgatagtagagcaggctacaaattacgaagcgacgcaaatgagggcatttgggtgagcttcacacaagttaaacgctggtttacagttgaaggatataatgattatgagtaaagttgtatatttcgtaaaatgctgccgtgacaccttagagttggtcgaccacaaaatgcagacctgtaaatgtggtgcttcctccatagatggtgtagccggagcctacgtccgttttctaggcgacaaaagtaacttcatgcgtctgaatgagttccagctcgaagttgaaaagaatcgaccggctctagaggcagaggctgagcgtctcaaagatttcgatgggaacatcgtagcatataacatggtaagcggtaaagacttctggtctgaactggctgaaaaacttaacatgccgcggcaggcggctaaggctttatatcatggcttcaactactcgccacgttggaattaagttttccaacagtaacagaacttacgtttaccgagtacctagttattggaaatactccccggagataggtgatgtagtagtcataccggggaatgttatgtttaataatcctcgtcgcgccaaagtagtagaagtgcatggtatgtatggtaagccagagtataaagaaagaaagaacatctcttatgtagagctgcatgattacttaccgaaggaggaacgtaatggacgataaaattgctcgggaagcaatagaacttgttcgtaaacgactggaagaacgtaatgtcgaggtgccgaaaataatgcttattggctacggcggcatcggcggatttcccagcttcactgacctagaaagaatggaacgagagtcccaagccagctttctagagttagaatcctacgctcgggaaatggaacacgaacatccgattggtaataactttatgccacgtagctcccgccaggaggttactcacggcaagactaattcctggcccactccgaaacgcagaggtagaaaatgattactacaggatttggatattctcacgaagaattgtgcaaaatggttgaaagcgctccgtttattaagaagttagtcgaagagcaacgaccggtgtgtttacatgctgcctgtaccaagtgtcacggtactggtgttgataaaaacggcaagatgtgcgtacatgcactgtcctgcccgtgtcctaaatgtagctggagctgttaatatggatctaggatattgtgtagtacatgaattcatggagcaggggttgccggatcgtatttgcgttgtaacctctcgtaatctggaagcagcccaatcactagtggagcgactctctggctactatcgtgaccatgaacgttaccagcagaaagtatttgacctgacaaaactgtaccatcaaaaagctctggatatgccaactccacagctggacgatctcaagcagtttagtcctgaggcctggtatagcgtcaaagacgccagtccggtagactataccgtacaggtattctcgcattatggtactcgtcactggataaaccgtaaatgggattccatggttgactaccttaattcggaactcgaaaagggggctgccgaatacaaaagaaagcgtgccgaagccaaagtattgaaaaattcagttgcattgtaggcgatttttcgatataatagttacataaattgatagggagagcttcatgagcaaactaagtattgaaagcattatccgcccgttaatgcacgggtatgtacaaggttcctgtgtaagcgaaactgaagctctcaatgttatcgaagaagagctggtggctaacgggtataatcttcacgaaggtgttatcgaggatctcttctggcagaccgcggaagatatggagatctttcggtgcgtgaattgcgggtggtggtgtcctgcttttgaaagggcggagaaccaaatagaggaaatctgccgggactgcgagccagacctcgaaggtgaagtggatgaacaagataacgaaggtgaagactatgagtaagcgttcaattgcagcaatcatcgcattcagtatgatgtactctggagtatctctggccgcagagcgtaacaaagtagagatctctgataacgggcgggttcgtgtaacaacgaatgggattactaaaggagctggtaagtttcgtaaatctgaaacccgttttggggaaactaagatctacacgaacaaaacctatggcaagcccgctgtgacactggaccgctatggtcgtcaggtagaagacgaggatgatagcgatgagtaatcttcaccccaaacttcaagagaccctagactggattaatgaagagtgtgcttttgaggaagctccttactgtgtctgggcaagagctggtgcagccccctcggagtggtgtactgtgtttgataatcgctaccggataacagttgaactaagcctaaaagaggacaaagtatacgctaaagcctctatgaccgcgctaggattatccgggttcgtggagatgcaagagctctgtatgcctaacactcaccttcgggttcagatcgagcagttggcaacaattcgtttgatgttgccggaagataacatcaatgaccatttccataaggttattgaaaatgaatacaaactacggcggcaacgtcgcaaagcacgacgggaagtagagaagactcggatgatgtgtaacatgaatccacacgtataacggtagggccgttataggagtcaccttcctgttcctatccggagtcgtgcccgcgatgaacgaagtggtgagttggtcgccgaccactaactaattcaaagacaaactgaggaagcaaaatgtttactttatttatactggcagtatcggcgtggatggcagttggtatcaatcatggtctggactctgctaagctgctgtcagctaaagccttcgagttcctggctaagtttgccacccgtaaagatatcgaggccatcatcgcaaaaggcggtgccaaagatgcatcgagtgtcctgaagtccttcgataagatcctagagcttcgtaacggtaagcatgccgcagagctacgctgtatgagtcgcaagaccataggcagactgtgtaaggccatcttcatcgtacagggggcgttgaaaggcccattcgctaagtataaaccggatagtatcaagcgagccaagatctttaacgattactgtgtggaacaccacccgttaaatcgctaactacccaagcccagcatcgaaaggtgttgggcttttcttttttaaaaattacttgcgctctcgcttaaaatgttgtataatagttttataaatgagaggagaactaacatgcgtattatctctaaattaaaggacgtatatgatctacaaggtactatgtatgatgcagaaagagcatggtatcgcgaagaagtgaaagaggttgtaaacgtatccgctgatttcgaacaaattattttctacgctgaaatcttgcgtaaccgcacttcctctggatatgggggtgttaatatgggaactctggaagttcgtccagtattgatttgtggtacactacgctggctgtacggttatcacactggcctaggagcagatgctgtgcatatccagactttcgatccagttaaggtaaaagaggtactggaagaacaaggatactacctgcggatgggttgggacatgaatacgattgagaagatcgacgctcatgttcgtaacgcaaccgccacggcttctgcgttcctggagactttcaacaagcccattgcgatggcatgggatgccgcaaagtctaagacagacccaacggttaatattaccgttaaaactgatttcaacttccatgcggaagatttcccgtggcaggaaattgatccaaacctgtatcgctggcaccagaccttagaatcatatatcttcggtgtgctgggtcaaggggaaccaaagaccgagtctacgtctgatcgtgatcggttaattgctaagggcttcgatgctaaagtttctttcaggaatatggagcggtaagactggagcaattctgtttctggcaattgcagcaggcaccttcgggggtgcctactacattaccaataagctaacagatatgtccagttctttacagtccctatcaaaccgtaatgaacaactagaaaagacagttggtaatctccaaacagagattcgaaatcgagatcgcaataccactacctacataaccaacctagctaagaaccaggaagatctggatgggcgtattaataaactggatgcagctagagccaaagagggcgtggttgccgctaaacctaaacttgctaccaaagtggcaaaagacaaagttaatgagttccaggagagactttcatgcgtaactggaaatatggactcctgctctcggctgcaattatcgcatccgggtgtgcagaacggccagacccaagtagcacagtaacgggggttgagccacagcacctaccgtggccagcaagcctacagacttgcccgtttaattttgagttcataaacgaagaagggaaagtgtatgttcgcataccttaccaagattggatcacgatgggcaagtgtaatgagcaggtctacacctacattgccaatctgactgcattaacgtgtacctatcgcgtgtcacttaatgaatatcgttgcaaaccgttcaataaggaaacaaaatgaaatacgttttaggattaattggtgatgccggcgcaggcaaagacacctttgctgacatggctaaggtttgggcctgggaagtcctcggtccggagtattctatcagtaaatttagttttgcagctccagtttacgaactcgcggctgtaatccttggagtcacgccagaaaagctggcagagcgcaggacaaaagagattaagcagtggttttgggtgactcaggaagcccttgagcgtactgctaacgtctggaagcgttttgggatcgacaagtacgccgatttctcttacgtttggcctcagtttgaagcgtcagcactatatccgttgattgctaagactgccccagacttttatcaaggtcgtgagaccccgttgtacccattatacacgtcccctcgtaaaatgctagaatttgttggcacggagttaggacgcgctctggtggatgagaacttgtggttgaatattgtggtagatcgtatcactgctaccaaagctgacattagtattatttctgatgttcgttttgataatgaagccgcgctagttcggaacttccccggtgcgcagaactctagtattcttaaagttcacgcccctaacaacatccacgctatccaatctactcatgcctccgctagaggtgttgcacctgagtttattgatgatgtggtaacaaataactttgacggactggaaaatttccgtaaaaatgtaaacgcattttgcgacgagaggattctctttatataaggtaacaatatgggacaaattaataacgtagagcagaaaggtggcaataagactcctaattacttcgcctccctagtggcgactaaggcagagtataatatttaccactatcatctcgatgggccgatagtcgatgtagactactaccgcgacctatcagtcactctggcaactatgcaagagggagacactcttaatctttatattaatagtcccggcgggtacgttgatacagcagttcagttgtgcaaccttatcatgaactgccagggaaccgtaattgggcacctggttgggccatcagcatcagctgcctgctcaatcttcctagcatgtcatggttggctggtgcacccttacgttatgttgatgggtcatacctatcgtggtgcgcactatggtaagggcaaaaatgagatccagcactatgctgatcagtttaactcgttcttcgaggatatgatgctagacctgtactacccgttcttctctctagaagagatcactgagatgatagaaggtggtaaggatatttggctgacctccaaagaaatcaacgaacgtgtagatcgtatggctgcgcaccgagaacaagaagctcgtaaggctgcgggtcaataaaactaagtaggccagggctttttagctctggcctttttctttatctaaattctacttgacatttgtctcaaagtatgatccgagcaataactataaatttttattgcaacttcctccaataaagggtataattataaatggttagaggaggttcttaatggataaatttatacagttgatatcgctgttactacaagaagcgaaggatccagcttctcttcttaaacgtttgctaaccttactggttggtctagttatctacctctttatagctaatacgagtgaagtcatgtcgtacttaaagactttctctacttcggcggtcctacaagatgttaaagtacaacgcacactagagtttccaaatgtggcacgagagaaggcaatgatcctattctcacagactcgagctgatgccgtcttcgtggttaaatacaagcctgaggctataaatgattaccaaactatcatagcttgggaaagcaacgttcagttggataaatccgatgtatccgacaaagcagttgacaagacgtctatgctctaccgagcgcatttagacggtctgaactttgcaattgatgcaagggaaaaacgaggtttatcgaagtggtctggaacgggtttgccaccgttcaagagtgcaaatttcgagtatgtgtacacgtgcccatattttaaccttaataacatctactctggatatgttgccgtcgcgtgggagaagtatcccctacaagacgaagacatgggtatgtttaatgactatatggcaaaaatctgcgcatcgccgcagagatcattagggagatcaatatgagtttcagatttggaaaccgtagtctccagcagctcgatactgtagatcctaaactcaaggctctagctattcgtgctctggaactctcaccgcacgattttaccatcattcagggcaaacgtaccgtacaacagagtgcccagaacattgctaatggtacttcatttttgaaagaccctagcaagtctaaacacgttacgggcaaagccattgacttcgccccatatatcaatggtaagattgactggaatgacttagaagcattctgggctatcgtcggtgcatttaaaaaggccgcaaatgagatgaacattgccgttcgtttcggagcggattggaataactctggcgactaccgtgatgaaatccaacgtggtacttatgacggcggacacgtagagttactgtaacattaaggggagcttttaggctccccttctttgtatggagcaagcaaataggaggtggttatgtttgcaagtttagtaactataatgctactcaagatatttcaattcggtatagtattcttttccgcaacatggattttaatacgcggtgccatttattttcgcagaacacgcttagctagggttgctagatggcttctacacttcgtatttggtattttcggtgtgttccgctgcccatgtgagaaaaagaggggaacagggttctgctggctctggttaggtctagagaattgcttctcattgtccttagcgctactatttggtatgatagtcctagctataacgctagcatttataccactaatgtacgcaggtggggtgacgtctatcctaacccttacttctcctgtgttgatgtactcagtataccccattacactatttttcgtaagacgaggcaagcactgcaattaatgaaaaattcaattgactttccgctcgatttagcgtataatatatttataaattcgagagaggagatacaaaatgtcagacagattctacactcaaatgtgcgagcattttaaagtatctccctacgagttaaatatagctttgtgggatcgtgaatcaccggagtttaagaaaattgctaagaaatcggagggtgttatgtccaacggtaagaaaatgacccgaattgaccttaacaatgcgctaaccaaactgctcggcgttaacattgagggccagaagctctctatgccaactttgactactattttggagaaagtcaaggctggagatgttaaaaaagtagcagtgcctgagggtcgtctgaaaaagccgtatcaggaggctataattgaggctttcggagaaaagctagacctggataccgcaaccgtaaaaacaatgaaagcactactggagagtattaataatgtctaagaaaattgtattccttaaaggttctagctgcgttccttgcaagcaatttgaaccagtttttgataaactcaccgctgagttcaacctgcccgttgaaaaacgcacggacgacgtagattccctacgtaagttcggccttcgcactgtacccgcagtagtcctggtggatgtggagaacggacgtgaagaagcacatcacattcttagtggtgccacgcttcgctctgcagtagttagtaaagctatccaagactttatcgactacgtagaagaataatacctaaccccggctcaatacgagaccggggttttttattatttgctaaacgcttaaaattttgatataatatttatattgaattgagagaggattacacaatgactaagcaagcatatcttatcctgaataatggttttgcagttggtactaccttcgttgatctggggtatacaaaagaagagtggcaagctctcgatgctgcccagaagaatcagcttgttaatgaagccgcctgggagtatgcagaggcttacgtggaggcggtagatgacgagttagttattgtcgtttcccttggtgccgtaggttgtgatgctcatgtacatacagacttccagagcgaagaagagtgggatgagttagatctaacccaccaaaatgctctgattaacgaagcgttctgggaagttgtagactgctacgttgcgttctgtaaggacgatgatgaagctaacacctgcactaactatggctatgaacacgacgatgtggagtgtgcataatgcaaaaattctctagagactggtcttctgatatggcccgtaaaaatcgagctgctgcctactataataagaaaatacagctcgataagttaataaagggtatcacctacaatgtagagaggggcttttctggtataaaagtagatgctaggagcctggactactcgtgcatactgtgggctaagcagaatgggtacgcgtttaaacgaataggcaatgagatactgattgcctgggaacccgaaggtctagtgcaatacgtaatatacgacccttatcgaggggaatatgtaagagatcacaggcagcagcccacagacttctcgctgccaaaacgttactatttagagacgaggtattaatgaacgtacatgaaacagttaccgtgcccgacaatgctaatatcttcttcattggggatattcatggcgagtacgacatgatgatgggtgccctgaaacttgcagggtacgaggaaggtcgtgactacgtgttctgtgtaggggatcttatcgaccgtggcccgaaaaacttacaggttctagcgaagttcctgtacaacccgaaattccgctctgttcgcgggaatcatgacgaattcatgatccaagacgactacgctaactggatgtataatggcggtagctggactatcacggaaggtttcgatacggataccatgaaaggtatcgcggaagacatggacagcaagatgccatacattatgaccgttgaacaccgtggcaagcgttacggggtagttcatgctggtatccctctgcgctaccaggctcaaggtatgggtgtaactgtaccggtgtgggacgacattgtgcacgaacacgaatctacaccagatttacgtcgtttgggtgtactgctgtgggatcgtgatgtaatccaagaagttgggtttaatctgtatcgtagtggggagaagcatccgtacttcgatcgctacgccagcttctccgaggagtgcgcagtcgatgtgcctgaaatcgtgggagtagactacacgtttcatggccatactggtgtcccgttccccattcgctggaagaaccgtgtctatttggacacaggtggcacctttaacggtcgtatgaccgtggcgtcgccggttctaggtcaattatacacattcaccacagatcgtgatgatccttgtggttccgctgacattatttaataggtgaaacatgaaacttttcaaagatctggaagaaggtgaagtattcgtagttgctggtggcttcgagttgcagaaatgtgtagcaatgctggacaacggaaactccgtgtttacagacgacgcgaatatctcggttactattgccccggacactgaaacctggaaacccaaagaattctgggagatccataaagatcgtccattggacgacctactggacgacattctattcacagcctgaggtaaatcatgaaactcgaatctcgttatattgtatttaagcagtcagatgccgctaagtatctaaccagcactgctattcgggagataaacgacagcttatccctgatctataaaggccgagaggctgacggcaaggtaggattcccgaactatatcgttctagaagaggattggccggagtatcctatcgctaaagaagctctagaaggacgtatcgtgctggaagagtttaataaaagggcggagaagaaacgtggggctaaggctgcagaagatcactataagcagcaccagtctacggaactactccggggtatttctccattctgtgcagggtggaacgactacatgagaagactggtaatcgaggagtaaccatgtatactggaatgggaaatgatatggccaagatgtttattggcctcttaatcctggctgcgttagtcggtgcagcaattgtaggcggaatctgggcgctcgtagcatttgtattttaaattcagttgcttccgagccaatttttctgtataatagctgtataaattgatgaggaagcaaatatgaaaaacgcaatgatcgaactgaatgcaaatatggaatcccttcgccacgcagttaacaccgcccgtgcttcttttaacctgctgatgcgcgatgagagcataccgctgtccgctcgtgtcaaggcatttgaggagttcgccgatgagcttcttcatatgggagactatctcagcgactccccgtttaatgaagatcgccgggattatcaacacgcctactgcaatcgtggggaaatagtttacctgaccgatgttctggagagtgtgctggagtatgcgaactctttcatgcgaactcctgacgaatgggaagacgcttcgaacgactatgttctagacgagattcaaaagaactggccagaaattaagaaactggtagaagaacacattcattctgaagtttacgcttaccggatcgattggtaaaaagtttaaaaattcacttgctaagtagttagaatttcggtataatatacgcataaattaacgaaacggacggaaatcattatggctaagaacactatctcttacaccactggtaaaactgctgacgaacaagctaacaccctgaccaaagacgaaatggttgcggtactggtaatcctgctggatatgagtgggttcgaaggtcagcttgctaaactgtctctcccggcacttcgtgctctgtacgaaggcactaacaaaaatgctgcggcctacaacctcgctaaaaatgaagcgcgctgggccaaggaacaccagcaggttgctgaacgtcgtgctgagagtttcgaacgtgacctgaaacgtgaaaaggcgaagaaaaagtaatggtactagaaattctctccgggctgttaatagcagccctagtaactggaacgggtctggcggtttgggtatcgatactgcgggaaaataaccggagaatgagattaaccaacaacgggctacacgagaagttgatggatcaagtacaagatgctgatgaattctctgctgcggctgagcgacttttagttcgcctggcgaagattgaagagattatcggccaagattccacaatgtcgaagacaaccaaaatgcggttgatcacggagattaagaaatgatctcaccaattgtagcggcactttacttagtagttgttggctacctgtccgggaagtaccacggcttcggtttaaaaggtactattaaggcagcaatgctggttcctctgtatcctctggcaattctgttaaccgggtactacgcctgtgttttaagaatctttggccggggcaaagttaactacgataactgcacagcgttgctggacgatattgaaaacaccattaagaaggaagaaaaatgaaccttaactccaaagaacgccaagtgttagtagatgctctgcgtcaggtagtagaccacgatttgctttgtgatgaagatatcgttgagtcaattgccctaatcgccaagattgagcttgctgagaaggactcatggcgtcctttgagtgagcttcctcctctaggcttggcaatcgtagtacaacgtgctgatggcgctccgtttaacactgtgatggttcgcagagatctggcaaagtcctactccccggatatcatcacgttgcacactaagatcaccaacgaacctttcgagtttaatactcgtcactattactggagactgaccaatgcttaatcagcttcgaatctataatttcctggattgcaacttccaggtctggcgagaactccccagccgtttcctaggctgggcattattcctctccatggtggtttcagtcttccataacgtcccagcgacgttctatatggaagcaattcaaccagtcactgtattcatttacgagatgtacctcgtagcaattaacgggtggaaagatggccgcatcaactgaagttttaaatcaatattttaatcgtgagcaccaagagttcagcgatctgttcatccagatgttcgtcaacgctaataacgctctggactatcgtttcttcaacgagttccatgagaccacgttcagccatcaggatattaactccgctctgaaagaactcattggctctaaagtgataccattccgacagactgcaaatgcagagacactagagcttagtgtcgtttggggcttgttcaagaaagcatatgagtttggcaagtatcagaacgcacgtcactggatttacgaggtgtatctaaacactgaagtcattctacctcgccaaatgatgttgggctggattgcaaaacaacgtcctgaacgcaatgcaaaatcattcgcaccaattaacgacgggaacttataccatgcaagtgaaaaatttgatgctccaaaatccgtggcttgatcgcctggcgcaagtagagaagatgcttctggttgaaggtctgaccgaagaagacatttgtctgaactccttctacaactgcaaaactcatgtaatgcaggcgctagacgaagaacgtgttgaactgagtaagtttatggtgaacatcgccacagctcaagttcactggcaaacccagggcttatccgccgacgatatcctgaaacataccctgaacgctattgcagagtatgggaaagctcgtggtgaagctctcttggcttcaaagaaagagtttgataaatcggagtcaatgctgaaaatggcaatcgatatccatatggaaggcatcgacggtactattcactaagagggtgacaaatggctaagaaacgcgttgtggtaaacttcctagaggaagattctggggactgcgagtacggttgctggaatactggctacggtgttgaggttatggtggatggcaaatgcgtccaccgtcaggaagcctgggcaagctgcactaacaacagcagcgtagactttgacgtattggcccatgttcttcagggcatcaagacgaaagaaggctacccggtcaaagcagatcacatcgactttggagatccttccgattatccagaggagtttctggatctgttcacctaacaaagaggccagggctaattgctctggcctttcgtggtttaaggatattaaatgaaatctatagacaactatttgcgcggggaaaaccctgtagatcaagcagcagttactgttgaaaaggtcaggaaagagtgttttatacttactcaacgtggaggtggtaatcggcctaatcgagtgtatcttaattggactcagtccaaagacctgtatgagaggttgaaaagggaatttgagtagtggaagaattaagacagaagataaatcaagagctagtatgggaagctaaatccttccccattaatcaattccttaaacgtgacggttcgatcaaccataataagataaagcaacttaggccagatttcaggcaagatgctaagaacctcatctttattaaccgtgctctagacgctcatggagtattcttcggatatgagaagctagtgttccacagcctaaatcagctggtggaaatatggtgtcccgaccatcaagattactttatgcaaactgctagaagccaccttgagggtaacggttgccaaaaatgcaggcaccgcatggttaccagagttacggattatggaagttacaccgtgccagcatactatcacaaattttcaattgacggagactccattatttggtataataactccagtaaattgataaaacctttggaggttaaagatgaaatacgattccctgaataatccgagcaccaactatctgactgaccagtcagtttctgagatcaagttccatccgaactactccccggactctagcaagccgagtgtagcagctatctccttccgcttccgcaatctgcgctttacgttcgttggagaggaagacaagatgatctctataattgacaaggttaaagcagtaagcgagctgtccggtagcgataccgttaagttcgaagcattaacctcgttgctgctgactagtggggctaccgttggtaagttcgaacttattcagccgcatgtttctgcactgaccaataccagaaacttctgggatcaagccaatgtcgagagtctcataaaatgggatagtgctactgagttctacaacaagtaagagggctaggatatgttattctgtacagttgattttgaagaagctaacgaaacgtatattgtctacggtatgtctgaaagcaaagtacgtatcctctggaatcagttccaattagaagtaccggacgacatatccaagactccgaaagacttctttcatttaatagatattaaggcagtaaaagctcgtaagaagctaactccttatgtgttcccaggtgcagtattcgtccatgagttaacagcgtatactaacgtggttctcaaaaagtctcgacagcacccaggctatctcacgatgttgacgtacaaagttggagctattcacgacggtgagctggtggttcgggtagatgcacgcttgcagcaagaagtcgaagaaatgattaggcagtgccaaaataaagcagaattaaaacaaagagcacgcctattcgacatggcagcacctagcgaggcagttgccgcatatcacggcttttataaagaaatagctgaatccgatgaagatttctttatgtaagaggataacacaatgaacgagaaatatgaagtatggactccggttggggagaattgtagctatcttcttcgtaccctgtgtactcgggaagatggcacatctttctcagaatacttgagtgaatgccacgctaaggcccagcaggacaacccgctatttaagatcagaggagaggatatcctcaaagttaacggcgtgccgtacacgccagtggacagtttcgccgctcttcaggtgtttaaggaacacagagagcgggagcaccggaggatgattgaacgcttgacaggtagagagccgttttcacatcctaggtggaatgaggagacataatgagcagagttgaaaagctacaacatatctataacctggttaagaaagctgaccaaaagaaactctcagagctgagtgaagaagagtatcaagcagtcctcttctgttgttcggcaatgccagcgaagctcgatggagtactggcaaagtcagacatccacaacggtaaggaaacaactttccagccgccgtataaatggctagcgtccaacatccagcaaatggtgggtaaagttacgggattctcaaatagaaagacgcctaacatctttattgacattactcctagaacccctgagtttacgaaggactggagagacgcattggattcatttccgtcatggaaagtcttttataaacctgacgatgaaacgtatgcacatcttccctttttgaagcacccaggctacacagttgaagacccaagttctggggttaatttcaaagacttcaagtgtactgacgagaacattgcttacggactcatgagaacatccgtgaggattgcaatggatcatgaactagacaaacaagatctagcagtcattgcactttgtaaggatcgttatattaaagttaagaggatcgcagagaaactttccgtactttcttgctttgaaacaatccgagattgtgaaccagagggtgaatatcctaaaggttccctctactggaaagatgttaaacatctaggactatcagaagaagccgtattcctaggcttagtagttacgggaagattcctgaggctacaggagaaataatttgtacttcgtctatattttcgctaatgaagatcagcggcttatccctaggcggaccaaggtgggttactcgcgtgacccattttatcgtctaaattcgcttcaacttcacagactacctcatcgtggattacaggatatcgttattcattctgtctatataatagatgacgccagcgagttctcagcaaagttgctagagaaggccgcgcataaaaagtttaagcctatgcgagttaatttcggtgacaagtttgatgggcatacagaatggtttgatgttgaacctcacgttattgagaagttcttcctgtcagttggggcaaaacaagtacctattgacaaactcatagcccaagaacaaaagattcgtaaatccacgaaaaagtagttgaaaaaaaataaaacgcatgttataataatctcatagattacatacaatttgaaaaatttatgaagctaggcggattatgaaccagaatcctggactcggggcgaccaagcctacgatgtcacagagactttctggtctcacataatccgcatgcctagcgcttcgtaatctcacatgaacgatggagaacctataactataataaaactaaggagaaaatagggaaacgtgggaatgaactcacgattactcacgtttaaaagtaggtaatccttacacaccatcgtttcgcggctctagggttgaactctagtcatctttctatacagggcggttctttctacacacctaaggggagggcggttattttccaaccctaaaaatccataaccattttctggaattgcacaaattttcacaccgtctcacatatcccacgaagccctcacacatctcacgcaatccctctagtacgcccaagttctaagcgtcactccacaaagtcctcacgaagtccccacacaaacccacgtcattcacccaagttctaagcgtcaaacattatcggatttgcacattgctcctagatattaaagaagccaagcatttctagatttctagcaattgtcggatttgcacatgacaaaacgattgtcggaaatgcacattaactctgaatccaaaaacacggtcgaatttgcacatataaaaactactatcggatttgcacatactcaaacgcttgtcggaaatgcacattattactgaagtacggtagctgtggatcaaaatcttcgattctgcgaatataaaatatctcctgaaatttcaagcctttttacacggtgtgtcaccgtgagttcgcttgttttttagagccacaggaattttttctgtgtcaacccctttacccccatttaactcataatattttcccttatctgccccctgcccccatcatccccgaattgccccaattaaccccctttatccctcccccaaaaatacccatcggatttgcacatactcacccaaactcgcgcccaccgctgcgctgcagcaaactgcgcgccttccccctaaaaattattatcggttttgcacatattagtatcggatttgcacatgcccctagggcggtaaaaataaattttcatcggatttgcacataccctagcagcctcacgtaatattttgcttgacacattgtcggattcgcacataagcgcaggaagggccgggggtcggaaatgcaaatacgaatgagagtgattcgcatttgagaagttgaatgcgaatgataattattctcgtttgataagctgaatacgaatgagaatgattcgcattccggaaaggaagtgagaaacactatcatttaagttatcaccagagttatacaaaattgtaaattagcttgacgcttgagaaggtcgcagacgagttatccacagacttattaacaggttatcctactggttatttatacagtagttcccggcaacactttctgctaatgtcgattttaagcgccctaggaagcgttctaagcgatttaaatttcgtgggggtattttagtaaggggtcacgcggtggaggagggcggcgacactcttacatatcgccgtggaaacactcaggccaaaagtgatttacaactgaaactattagcagggtaatgattgcgctaataactatcatgcccaaaaacattaggccgctcattattggcagctctgcaaaaagactagggtcataataataaccatgatgacacgaaaaccccactcaccgccgccaccgtcaccgcctttcttctgaccgtcacgaataacgttcaattggtaagtattgtggctacggcttttgggactaccaccgcgtaaagttcgcattaaaaagcctccttattaaacaaggtatcatagagggcatagccgcaaaaagcgataaaacccaaaaccatcatagaaccaactaaaccgagcgccaacattgaaaaagccatttttcgatctcctatatgggtgagtcataataataacataactctagcgggaagcaactactatttttagtagtagacaagcaaatccgatttccctatagtttgatctcccggcaagcatagaaaaattttgcttgctaaaaagcggagaatcttgctataatagattctcagccaaacaaaggagtaacagaagatgttacagaaatttacccccgttgcaaatttgcctatggttcgcggtggcgctcgcaacctgttagatggtagtaaatgcgcctctatcggtcatattttaggcgtttaccgctcgaatatggaaagtagaaccagccgcgcttttgaacatagccgcgactacgttctagccaaccccggcgctgcgattgttatttttcacgacgatcaatatttagttgacagccagcctattgatctgatagtatctaccactacggacgcttatttgtataaggcatccgaaggtaagcaagcgtcaagacgtttttgctaccatgaaagcgaactgctcgctttcaccgatgcccgcgcatggattaaaaacctgtgcgatcatctggaactaccaccagcacgaatttctagcgaaatgatgatttttgtgcttgacaaagacggaagcatcctgctaccatgtgacccttacgatattgatatcgaagaaggggcaaggactggaaattatcgttatgatggcgagctagaagaagtcgccccggctgttactgaaaatgtagttaaccctaataattttgagactggagcattacaaatgaatactatcaaatctaccgctaccgctatcgttgccgctaacaaaaacgctgctgtaaacgctgctaaactggaagccggttctatcgtcctgaaaaaagtttccggcatcgccgccagcaaagcgccgtttatggttcgcggttatgttgacacggcggtaggtcgtgtggtaattgctaacctgctgaatttcgcggttagccagtatgcgccgaacaaccgcaaagcggtgattgcggctgacgctgcaatgcaagccgccatgttggaactggtacaaagtttcaatgtaggcgaaatgattgacgaagtattgaaaggcgtcaatctttctagcctgattgaaagcgacgtagcagaataattatatctagcgcctctataatggggcgctataataattaccctgctaactaactggagacaaaaaatggaacggctaaccgctactttcgaaggcgaaaagatgacgatcgctaatgtatggcagcgcctgcgccagaatggcgatcgtggcaattttgctattttcatcgagccaaaaaacttggataatctggctcgccagattgaccgccgggactgctacccggatacagatgatatgctgggaatccccttgcggattatcggggtatatggttacggctttgatatctgtattggtgatagtagctttgaaatcgactgcgaatccggcgctaccgaaatcgaagtattcctaattaatttaggctcgctaacgtttttggatacgccaccagcggaaccggaaccggaaaagctggaggtgaaaacgtccgttattgttagttcgctaactatggatgagctggcggatatcgtgtcaacgtatgacgaaattcacgccgacgcgattaaagagctaaacaaccggcttgatactttccgcgataagctgtaaaatccctcccggcggctaaatctctagccgcccccattattggagaaaaccatgtttcatgtgaaatcttgcgtaccgggcattaattatacggtagaagcggaagaaggtttatatttagagggcgggcgaattgagtctcaggaagtcgccgccgtcctcaaatgtgacactaacgtttgcggtacgtcctggactgaccttcattttttaggtcgtggaattgacgtcgattccctttcctgggaaaaggcttgcgaacatgctgaaagtatgctaaacgaggatgattgggatgatgacgacagcgacgaaaaatacgcgaatgctggggtagaagggtcgttttatatgtactggcccggtcattcctgcaacctcgttaatggtggttcgcccctccattccgttctagagcgggcaatctatttgggctatatccagatagttgacggaaaggcagtcattaatctgcgcgaattgaaaacgtttatctatatcccggatgctgaaactatccttcatattgaggaaggtttaaaatccggttggaaggttagcggggtcgtatacctatgatttacatctatgtcaacaaatattttctggcgcactataaaacgatggaatctgtgatccagtacgttagccgccagaatgcaaggcatattgatgaagtggctaccctcaaaatcggattgcggggcgatgctatcaatattagctggcctttgctaattctgatttgccgtgatcttgtagcgggtaaacctgtttccgtttccgcgctgggggaatcttacccgctttccgatgatctggatctctatgatctgctaaccaaatataaaactgaacgcctgttttatcgtggcgggtcggtatgctctagcggcgaaacaatagaaacggtattccgctaatagttagctaactaatgataagcctgcttataatgagcgggctttttatttttctgcgcccctctagcaatggcctttaatatggcctctaaatttaaagcgcttagaatgcgttatagagcgttctagaggcatattagagtattaccgctgccggaatatactgtataaatatacagtaggataacctgtggataagtctggggatatctcgttataccgcttctcagcttgtcaagtcaaaacgtgctgtggataacttgcccggaaaacaggagtgcagcataaaataaacgcaagcattattttgcgttttcataaaaataatcgtttgtctagtggataactaattaaatttcatttttgctttttgtataagttattaacagggtctaaaacgccctagaatcgattctaagcggttttagataaaagccgatgaatcataccgggtatgaggcgatctcctcacctcgtgtgaaatagattttgtcaaccccttttgaagaaaaatagtaaaaatattcgttgactttctttaaatattgtgtcacgtgcgcgcgcttcctatctatcgtgggcctgttttctctttacgcttctttacaattctccgcttgcggctaaacgccattgtgttattatttatctcgtagggcggcaagacgaaacggaaacacgaaagcgtttcactagtagttaggtatctggaggcggcaacattgccccgactaccgcgaaaggaaaggccgaaacgatatagtctgcccccgccctacactgctctttaaaaatttgggattctataaaaagcgttatcggctttctttacttaataagggaaccgaaaacatgttaaaagaaaacgtaatgagtagcgagattgtaaacgagtttacagtagcagacgccgaacattttatagagacttatttaaatgtgtacgacgtagatttagccttcattcataaagacggccaaatc

SEQ ID NO: 7 - DNA, 29868 bp, Klebsiella bacteriophage F92/15
acaaaagatgatctaggagcgaaatatcacgttctcaagatgtcaccgtatgcacaccgcttcgctgctaaggttttcaatcagtggttctcttatccgcagattaaagaactctatattatagaagatgaaccactaaaacatgacacactttatggttctcatgctcctagctataacggtgaccccttccgttgtgcattaaccagctaccctgatcattacttacctgtcagagcatctgaaggtaaacatgagatcttcgcagtttggcaaggcagtaaagcaatgaaagatcttaattcttatgtttataagatgcgagcatctgtcttcccaggcggtgatcctaagtttgttactccctggggcattgagaaagaagaaccagccaaaccagaaactagacatgaaactctacagttattcgattaccataaaggggatggtggtatcaccccgagtatcgtagcgcatgttgtattgaagcgtgaacatccagatctcttcattaagctgtacggagaagactatgaattctcctttgatcagcacctcctcattaaggatttcgatcaaacgaatcctgccttcctaactgagttagagaacctacgttctcaactgtagtctacgagttcacggggtaaacatctaccccgtgacactttttcaaacactctacgtaaaaattcttgacattatttcagatgtatgttagaataactctataagaataaaaaagttaagcttaaatagatagttaacacatccgctagagatgtgcagatattgatttttcaatttcgtaagtgtcagggccctgtcccgattcaagacacttagtgcgaaattacaaaaattagatcaatctgcacagtatcgctagccggggtgtgcgatagctcgttaaaaccctaaggggagttattaattactggaaactaaggagaaaataggtaaacgtgggaatgaactcacgaatactcacgtttaaaagtaggtaatccttacacaccatcgtttcgcggctctagggttgaactctagtcatctttctatacacctggtgacagggcggttctttccacacacctaaggggagggcggttattttccaacccactttttcggaaagcaatttccagaaactcacacaattccacgaagttccacacatcccacgaagtccacacatctcccacattaaaacgctagctgcctaagtcctaagcgtcactccacaaagtcctcacgaagttccacacaaacccacatcactcgcctaagtcctaagcgtcacaaaatatcctcggatttgcactaacctctagctatgtcggatatgcacatataaaaatcatcatcggaaatgcacatataaaaactaatatcggatatgcacatatatactagcaaacggtagctgtggatcaaaatcttcgattctgcgaatataaaatatctcctgaaatttcaagtcctttttacacggtgtgtcaccgtgagttcgcttgttttttagagccacaggtaattttttctgtgtccaacccctttacccccatttaactcataattattttcccttatctcgccccctacccccatcactccccgaattcgccccaattaaccccgtttatccctcccccaaaaatacccgtcggatttgcacatacctcccccacgactcgcgcccaccgctgcgctgcagcaaactgcgcgccttccccctaaaaacttatcatcggttttgcacatattagtgtcggatttgcacatgcccccacgggcggtaaaaataaattttcatcggatttgcacataccctagcagcctcacgtaatattttgcttgacaaattgtcggattcgcacataagcgcaggaagggccgggggtcggaaatgcaaatacgaatgagaatgattcgcatttgagaagttgaatgcgaatgataattattctcgttcaccgagctgaatgcgaatgagaatgattcgcatttcggaaaggaagtgagaaacactatcatttaagttatccccagagttatacaaaattgtaaattagcttgacgcttgagaaggtcgcagacgagttatccacagacttattaacaggttatcctactggttatttatacagtagttcccggcaacactttctgctaatgtcgattttaggcgccctagaacgcgctgtaagcgattttaattttcgtgtgggtattttagtaaggggtcacgcggtggaggagggcggcgacattcctacatatcgccgtggaaacactcaggccaaaaatggtttacaactgaaactattaccagggtaatgattgcgctaataactatcacgcccaaaaacattaggccgctcattattggcaactctgcaaaaagattagggtcataataataaccatgatgacacgaaaaccccactcaccgccgccaccgtcaccgccctttttctgaccatcacgaataacattcaattggtaaacgttatggctacggcttttgggactaccaccgcgcaaagttctcattaaaaagcctccttattaaacaaggtatcatagagggcatagccgcaaaaagcgataaaacccaaaaccatcatagaaccaactaaaccgagcgccaacattgaaaaagaccatttttcgtatctccttttgtctagagtcataataataccatatccctagcagtaaacaactactatttttagtggtagacaagcaaatccgatttccctatagtttgatctcccggcaagcatagaaaaattttgcttgctaaaaagcggagaatcttgctataatagattctcagccaaacaaaggagtaacagaaaatgttacagaagtttacccccgttgctaatttgccgatggttcgcggtggcgcccgcaacctgttagacggcagtaagtgcgcctctattggtcatattttggccgtttatcgcgcaaatatggaaagtagatccggctatgcttttgagcgttgccgtgaatacgctctagccaatcccggcgcggcgattgttatttatcacgatgatcaatatttggttgacagccagcctattgatctgatagtatctactactacggattcctatttgtataaggcgtccgaaggtaagcaagcgtcgagacgtttttgctaccatgaaagcgaactgctcgctttcaccgatgcccgcgcatggattaaaaacctgtgcgatcatctggaactaccgccagcacgaatttctagcgaaatgatgatttttgttgcttgacaaggatggaagcattttgctaccatgtgacccttacgatatcgatatcgaagaagggacacgtaccggaaattatcgttatgatggcgagctggaagaagtcgccccggctgttactgaaaatgtagttacccctaataattttgaaactggagctttacaaatgaatactatcaaatctactgctaccgctatcgttgccgctaacaaaaacgctgctgtaaacgctgctaaactggaagccggttctatcgtcctgaaaaaagtttccggcatcgccgccagcaaagcgccgtttatggttcgcggttatgttgacacggcggtaggtcgtgtggtaattgctaacctgctgaatttcgcggttagccagtacgcgccgaacaaccgcaaagcggtgattgcggcggatgctgcgatgcaggctgctatgttggaactggtacaaagtttcaatgtaggcgaaatgatcgacgaagtattgaaaggcgtcaatctctctagcctgattgaaaatgacgtagcagaataattatccctagcgcctctatagtggggcgctataataattaccctgctaactaactggagaacaaaaatggaacggtttaccgctacttttgaaggtaaaaagatgacgcttgccaatatctggcatcacctgcgtgataatggcgatcgtggcaattttgccattttcgtcgaaccgaaaaatttggataatctggctcgccagattgaccgccgggactgttacccggatacagatgatatgctgggaatccccttgcggattatcggggtatacggctatggctttgatatctgtattggtgatagcagttttgaaattgactgcgaaactggcgctaccgaaatcgaagtattcctaattaatttaggctcgctgacgtttttggatacgccaccagcggaaccggaaccggaaaagctggaggtgaaaacgtccgttattgttagttcgctaactatggatgagttagccgatattgtgtcaacgtatgacgaaattcacgccgacgcgattaaagagctaaacaaccggcttgatactttccgcgataagctgtaatatcttcctcccggcggctaaatctctagccgcccccattattggagaaaagcatgttttatataaattcttgtgtaccgggcataaattatacggtagaagcggatgaaggtttatatttagagggcgggcgaattgaatctcaggaagtcgccgccgtcctcaaatgtgatactaacgtttgcggtactggctggactgaccttcattttttaggtcgtggaattgacgtcgattccctttcctgggaaaaggcttgcgaacatgccgaaagtatgttaaacgaggatgattgggaagaagacgacggcgacgaaaaatactgtaacgctggagtgggggggtcggttttatatgtactggcccggtcattcctgcaacctcgttaatggtggttcgccccttcattccgttctagagcgggcaatctatttgggctatatccagatagttgacggaaaggcagtcattaatctgcgtgaactgaaaacgtttatctatatcccggatgctgaaactattcttcatattgaggagggtttaaaatccggttggaaggttagcggggtcgtatacctatgatttacatctatgtcaacaaatattttctggcccactataaaacgatggaaaccgtgatccaatacgttagccgccagaatgcaaggcatattgacgaagtggctaccctcaaaatcggattgcggggcgatgctatcaatattagctggcctttactaattttgatttgccgtgatctggtagcgggtaaacctgtttccgtttccgcgctgggggaatcttacccgctttccgatgatctggatctctatgatctgctaaccaaatataaaaccgaacgcctgttttatcgtggcgggtcagtctgctctagcggcgaaacaattgaaacggtattccgataatggaaaagatacgtgtattagttagcacgcaaagggttattaaccttactcatgaggtggaattaacgccggaggagtatgcaaagttagccgcccctatcactaatcacgagtgtgattattttgcctgctattagtgaattgcgaaatcatgagtctgctaagttatgggatgaatggtggacggaagaagcgcctgtttcatttactgaccacgataacattacctatacggaatagttagcaaacgaattaaaagcctgcttataatgagcgggcttttttgtttttctgcgcccctctagcaatggcctttaatatggcctctaaatttaaagcgcttagaatgcgttatagagcgttctaggggcatattagagtattaccgctgccggaatatactgtataaatatacagtaggataacctgtggataagtctggggatatctcgttataccgcttctcagcttgtcaagtcaaaacgtgctgtagataacttgccccataaacgggagtacagcataaaataaacgcaagcattatttcgcgttttcataaaaataatcatttgtctagtggataactaattaaatttcatttttgctttttgtataagttattaacagggtctaaaacgctctagaatcgattctaagcgcttccagctaaaagccgatgaatcataccgggtatatggcgatctcctcacctcgtgtgaaataggttttgtcaaccccttttgaagaaaaatagtaaaaatattcgttgactttctttaaatattgtgtcacgtgcgcgcgcctcctatctatcgtgggcctgttttctctttacgcttctttacaaatatacgcttgcggtgaaatgcgatatgacatattatttatctcgtaggacggcaacaacgaactacacggcggaaaacatcccgccccgctctttaaaaatttgggattctataaaaagcgttatcggcttctttacttaataaggaaaccgaaaacatgctaaaagatgccgtagttaatagtgaaattgtaaatcagtttacagtagcagacgcggagcacttcatagaaacttatctagaggtgtacgacgtggaaatgaccttccagcataaagatggtcagatcacaatgcaaactaaacgaaatcatacactccactaattaaaggttgacaacatgaaacgctttgtaatatcatctaaaccggcagcaaaattgaacaaaatggcaagttcggaactggtcaaaatgcaacgtgatatgaaacgccgttttcgttcatatcagcgcggaggtcagcaaggcttgccgatgatttgggataacatgatggcttatttaaaatctttacaaaataacgcttgacagtctgccgataacgctttattatagaatctcaataagcaataccgctctttaaaaatctggaaaagtcgattctctcagtaagggtaattgagttttctgttaacactctagcagtaaagagtgttaaccggataacccaataaactaaactggagtaagaaacatgcaaaacgttaaaaccccgatgattggtgattctgtttttattcctttcgttactggtgacgtaagtaagccgggcgaaaacgaaaaaatcggatatatcaaaggggcggcgatgatcccgtttgataaaatcaacgcggtatacgctgaaacggaaaaagacaaaaaacaagcgacgcgaagatttacagcgtccgggtagattccggcgacgtggtgaaagtcattcgcaaagatgataagtggctggctgttagctaactatttataccgcttaaaatatcatgctttgagcggcaattgtgagttaacacgaatctatagcgtgaaatagacgtaatagcgtaattattaaaggcagcgtataaatacaatgccgctttaaatagccttaaattgaaaactaaaataaagagttttcgttatatattctagttagaatatatagcggctaactttctagccttaacccttaaataaaactggagatattaaaatgactgctactaaaaccgaaaaattacgcatggaacgaaaccaacgccgcgaccgctatttctatgtatgagggtattattgccgccgaaggtctggaggtagccaactcgcaaggtcttatcgatattgcaaaagcggttggcgctgaatctcatgttaaagtacgctctaaactggttagcgcaaaggtttatcagaagtccgataagccgcgcaaagtcggcggcggttcttccctgcgtaaagctcactatgtgcgcgtcctcactcagcacgccattgctgatggcctgattgaagatgccgatggtctggcaagtctggaacaaatgaagctcgaccaactggacgttatcgcccgtatggttggcgttcaggatgaagtaaaagagtcggcagaataattataatgcgcctccctagcggggcgcataattaaatattttgtcccccataactggagaaataaaaatggctttaattaaaggtgccgttattaaattaacgggaaccgtcgtggatgaattaatccgcgtaggttatcagaatgacgcgattatgacgccgcctagcgttaaggtgccggaatttgtcgttttatatgtcaatcccgataatgatcattttggtatcgcaattaaccgcgatatattcaagccggaaatgttagaattgcccgctcgtgaaatttgggtaatggattacgctttcagttttgaagaaaaggagattgtaaaatgatctttttccctactgaatccctaatctttatcgctggctttttcgccgccgcttgtctctatggttactataatttcatggaaataggtagcgaacaaacggatttattacgccgtgacttctggtttaagaaagcgaatatttgccgccgctggtcaataatctttattattctagcgatagcttttggaatatccgccagtattattcctgcaatagtttagagtcgcaaattataacgccaccagcaacaaggcgttatatttggcaattctgcctataccccattaactggagaatttagataatgatcattgcaatcgagaaacagaaagctattttaaccgctgcaactaacctcaacttttggggtaaacgtctgcgcgctaaaaagctggagatctgcgacgaattgagcaaagagcattacgggacggcgaaacattctagcgaaatttgcgattggctggataataacaagcctgttaaacctgctgctgaaaaacgcgcccaacgtgttgcggtggaagattcccgccccgttgccgctggtcagcttaattccagcgtcgaaagctggaaggtaattccgggccgccgttttcttttgacttcgattcaaaacaatacgttccctcatgctaatttctggaaaaccttacaggaggccgcgaaatatctcggcgcaaccctgctggtgagcaaatacgcctacaacaaaaaaggcttccaaaacgggcaaggcaacgacgaactgaaatatgatgatgctttctcagatttcatttgtgatgaaaacgtgtttttgggcaaccgtgaaacaggttttgcattcatggcggaaattaacattctgcctactgctgatttcccgctgtctggttttggtgaaacagcaaccgcctacggcctgaaagggctggctatcggtcacgctaaaatcaccgccgaaagtgtcccggcaatgaagggcgacactgtgcgccgtatgtactcaactggcacggcgacgctgaaaaattatattcagcaaaaagcgggccaaaaggccgaagcgctgcataactatggcgctttgctggtagagatcgacgatagcggcaacttctttgctcgccaaatcgaaacgatggacgaaagcgggatgttttacgatcttaaccataaatttacggttaacggtggcgaagaagtaacgggccacgttgccgcgctgcaatatggtgacattcacgccgaaaaactggatttagctgtcgcggcggcaagctgggggccgtgtgatgattctctagttaacgtcctgcgccctcgttaccagattgtgcatgatgtgcatgatttcacgtcacgcaaccatcacaaccgcgctagtggcgttttccttgcgaaacagtacgccgccggacgtgacaaggtaattgacgatctcattgatacgggccgcgtactggaggcaatggagcgtgaatttagtcaaacggtcattgttgaatcgaaccacgatcttgcgctatcccgctggctggacgatagcaaagcaaacattcagcaagacccggcaaacgcccatctttattatcgcctgaatgccgcgatttatgaggcaatcgaaaacaaggacgatacttttaacgtgctagattatgcgctgcgtcaagtggctggctgcgattttgccgcgatcttcttaaccacggacgaatcgatgaaaatcgcgggcattgaatgcggttcccacggtcacaacggcattaacggcgctcgcggcaacccgaaaggcttccgcaagctcggcaagatgaacactggccatacgcatacgcctagcatttatggcggcgtttataccgctggcgtcgctggttcccttgatatgggttacaacattggcgcgtctagctggtcacaaactcatctgatcacctatgaaaacgggcaacgtactttgattgactttaaagacggcgctttctttgcataataaaaaagccggggtaattccccggcaataaataacccctaaataaataagctggagaaacaaatgaaacttactttcatctatagcaatcgtaaatctttcaccgcgtccaacgtcgtagaaaacagccttgttattacccgcgatagcgaagggcgcccccatgttagctatcaaaaaatacatcaccgttgacggcgccacggtattaaaagccgtgaccgatattctcccgcgccctgctgattttaaagagtcgggtattatctcccaactggtagccgctgattctattctttatgaggctgatatttgcgagatcgtggagattgacgccgccgccgctggccttatgtttatcgtcgtaagcgaaaatgattatgatgatacctatctactcggcgacgtgatgaactacggggaaagcgaatacaccccgccgcttgcaatcctcccggtgctggctacccggattaaaccggctgaattagctgatgccttaactttattcttctgataattaacaaagcgagttataatatagctcgcttgattaattaccaacaaccccgaaaccggagaaatgaaaatggcttttaataaactggcaatcaaaacgatcaagttatgggatttagacggaaccgttattaattcctttgcccgtgtgttcccgtgtatggatgataaagggaacttagatttaaacatgtaccgggaaaaggcttgcgtacatgatgcaatcatgaccgacactcttttacctttggttgaatatatgcgggcatcgcttaatgatcccactgtattaaacattattgttaccgctcgttatatagggaaaaagcgattactatttcctccgcaaacaacgtatcagggcggggcgcggtggcaatatccagatcttgtcccgcgatgtattgcaccgatatattggcgatgctgattataaatcggtgtactatgcaaaagacggtatctataaaacgcattatttcgaaatgcttaaagctgaatacccgaacgctactatcaccatgatagacgataataaaggcgtgttggctgctgctgctgctgctggccttcaaacgatggacgctaccgcaatcaatgacattctgtctattggtgtgcgccttgctggtgagtcattcatagatgaggcgctggatgatgataatgattatcaatatctttgcgagcgtttagcccactgctgggaaggtatgaccgaagaagaaagaagcgactacggaatcaagccgcaacaattcattcaatcgttagccatcgcatcataagaaagctaatagtaccctagcgaaatagttagggtactaatagttagcagggggcgggtaatcggactaccataccaccccccgacccctctaagcccacctccatgtgtaactttatgaaatttggagaaaaggctaaagggagtattaaaaggaacagcccgaatcaaagctactactgctactgccgctgtcgcagtaagaacttcccgagtcatacccgctatacgttgcaactgccgcagttgtagctatgattgccgcagtcgacccgtcatcactccgagaactttccgagttcgatgaaggacttcccgaaactttccgagaattatccgagcctgcccgtttttgcttgcgtctcgcgacctgcggtgtcacaggagggatgtagtacgggttgctcgggtcattccgaagatcgttcatgactcgttggtgttttgagatcgctacttgccgttctgcccgagtttgaaggatctcttgatgcagacttttgttacgaagatctgccgctactaccgcgttccgcaggtcatgtgcccgtacaccaaaccaaactgctgccaggaaaaagaatgttgtgaaaattaatacaatagtcatgttttacaccatacccttagtaatgtagattttgtttgctgattctagttctgccttgcattcagacaggtttaactgcgccttatgcagcaaacgggtttggttgtcataagacttttgcaacaccccgttagtgcgttctagctgtttgattgccttaccttgctttacggtaatgacaaataatacaattgagagcaagataagtgctcctataactacttccatagtggtcctcctagatggttttaaaaaatactggtttacttggcggttgatttaatttataataatattatattataaaagtcacttgttagcaagtgagattttgaggtttttatggggttttatgcaggaaggataggcgacaagaaagtattgtctctcacctctggcaacaataaagacgtcaataaccatacaaatccaggttgggatactatattccatagtgacatgcctcacgtcgtagttttagaaactcacgaaagagacctctgggatggtggtgattggtatcgttgtactagaatgccagacaggattattcaggtactgtccgcagactacgacagggttgtcttaactgaagttgagtttgaggacggtactagacgtttcatttatggtacttctctaggcgttggcgctaaagcgtataacgcttactttagtaatactgtcggttcccaggtttctgcaggtactatggctagtatgaagactaacgtttgtgcttctgctgacttacatatggatgttagcttctactttgaggaaactccgggtactattaatgagaagttgcgtgatggtactgggtgtatgtacacctggggcgttaactcagaatggggtgaccggggtcctgggccgccggttggagctcctatacctcctaactttgagactattattaaagccggttgggtactctataggggggcttttaccggcaatatagccggttctgtgtctccgcccaatagaccacttactattggtgttgatgcaatgcgccacccatggatgcgtaccacaggagttaatagtatatgtttgcgcggtgagactctcaaccgtaatatgtacggacatatgggacctagatatgggcagagctccaatccggtcggtgggccttactctcacaatatccagactgagtcttatcaggagattcagtacaaagctaggttttttccgtggtccgcccaatagctttatggggtgggagaacacagataacaacaatgctggtagtggttggggtaacaacgctatttatagggataacaacttccgcgttcctaagcgtgttcgctggtatattactaatatgaaatacaatgggcaggggttctacgcagagaacgtatttggctctcgcaaccaggagattaaaatcagccctagagagttcattgtaaacggtataaacctaatgaacactgggtggaagtttataaaccagaacgatataaactacagcccaggtaataggccggatatccgagttattgcgaccaatgtcgctagatttagtggcaaccctactgttggtaataacggatatgttcacttcaaccagcccctaactcgaccggataatggtgcggagtttgggcaaggtaacataagtgagatgcatgtaaccactgtaggagtttacaattttagatctgatgcgcagtggtatgtaaaatctaacccaccggaaatcggaaaccagtggggtccagtatggtctgaatcaactcgacctctccgcctagtgggtggtaccggctctgctgatattggagggaacctacgtactagcggtaatgctagtcaccacctggctaccttgtggttaggggttaataactcccgaaatggggcttgcgtcgtcactctagactggaaaaatgatgagtggattgctgctgcagggattgggtgctataatcctctagaagaccttactcagtggagcgaggtagatagtaggctgagaattttcggaaatcacttccagaaacgtgtgcatcaaatcatgtgtttgcccgttaacatgtgtgtgcccttccactttatacgcgggaccgtaacccagtgtggggttattcctgggaacaacgccatgcaaatgaaggctatgtgggcacctgctactactaactctgctacgcagggagactacgctattatttattggctgatagctagagctgacggtagtgttgaggtttgggttaacgttgagatgatcaatattatgaacatgcgggtgatccttcctgaggttaggattgctgtgcaaaggcttgcctaaggaggcagtatgagcaatgatttaattgtaccagatgcaatgtctccagaaggcatgctagttatagaggcctacttggagtctggcagcgacgttgcgaaagcagcgttagctgttggtatggaggagcccaaattccgtgagattatgcgtaaacccgaggtcaaagcgtacctcacggatatcttcatggagtctggcttccgtaaccgtgataaattctttggcattctagacactgttctaactatgaaaatggaggaactggatgaaactggaatgggttcggagatggatattatggatatcctcaaactcatgcacaaaatgaagatggatgagatgaagatgcagatcgagtatgagaaggtgaagcaggctaaagctcctgtacaccagactaatactcagatcaacttggcaggtggtcatgactctaattacactgatcttctgtcacgcattgtgggggcgtggtaaataatggagatctcacgtagttatattaatacaactgacgtggtggattttggtgttgataaacgatctttaaattcccggtgtccggcttgctggccaccgagggcatcaccccaaatggtccacagtgtgcaatcataaacgcactggaagacccacgtcaccgtttcattacagcatgcgtatcccgtcgtgttggtaagtcgttcattgcgtatactctaggcttcctcaagcttctagagcctaacgttaaggtgctcgtagtagctccgaactactccctggcaaacatcgggtgggcggcagatcaaaggtctgattaagaaatacggccttcaaactgagcgtgagaacgccaaagataaagagattgaacttgctaatggttcgctctttaagctggcttccgctgcgcaggctgactccgcggttggtcgttcatacgactttattatctttgacgaagcagcaatctccgacgttgggggtggacgcttttgatatccagctccgtcctacactggacaagcctaactctaaagctctgtttatctctactcctcggtgggggtaactggttcaaacgcttctacgagcaggggttccgagaagatcttccgcagtgggtatcaatccacggtacataccgagataaccctcgcgtatctcttgcagatatcgaggaagcacgcaagactgtatctaaaaactatttcaaacaggaatatgaagcggacttctccgtattcgaaggtcagatctacgatacctttagcgtttccgagcatgtacaggatctcgcaggtatgggtcacttctttgccgcagaccacgagttcgaaaccattctaggtatcgacgttggttacagggacccgacagcagtacttaccattaagtaccactatgatcaggacatttactatatccttgaggaatatcagcaggcagagaagactacagcacaacatgccatgtacatacaacactgtatagaccggtataacgtagaccgtatctttgttgactccgcagccgcacagttccgacaggacttagcatatgagcatgaaatatcttcagctcctgccaagaaatccgttctagatggcctggcatgcctagctgctctgttccagcagggtaagatcattgttgatgcctcttgtactgcattaattcacgcactccagaactacaagtgggacttccaggaaggggaggagaagctctccagagagaaacctcgtcatgatgccaactctcacttatgtgacgcactgcgttacggcatctactcgatttcccgtggcaaataagagctgagttggaacggatagtagtgagtacaaattccgttccaactttataaaattcactttacaatttcgtgtgtggcagttataatatattcataccttgagagatctcatagacatcagggtgaatgagaggaatatttaattgctgtacccgaagtagtattttcccaactaagaggagaaacactttggcttccaatgtaaaatataagagagatgcaatctccataatgcgtgatggaatcaaagcccagtacaaaagaggcaaccgttgcgccatttgtgactcacaggaaaacctggagctacaccactactcgactgtggccttactagttaaaaactttgctaaagaattccaactggatttcactgactcagaagtcgtcctaagtaatcgggataagttctataaacattattggcatgagctagtagaggacacggtcaccttatgtgtctttcatcatcagaccctgcacaaggtctatacgaaagaaccgccgtgttttcagctaacaaacagaagatttgggttgagaaacaacgtgaaagatgtatgaatccagaggcacctcgtacaagcaacactggcgaaagatcaggctttgcgaagtggcttccgactgacgtcaagactgagaaatcaggattcgcaaggttcctataatggctattcgtgactggttagttactaaactaaaccgcggacaacgcataatcagggacttggaggatgttagtcaccgtactaacgtcaagccattcacgactggcaaagcctattcgtctattgagatccttaatagatccgcgaacatggtaattgacagcgccgctgagtgctcctacaccgtaggtgaacagtataaaacaataacaacctatggcacgatcaggagtaaaactcttgagacgctgcttaatgttcgccctaacccgtacatggactccagtacttttagacgcctagtagtgtctgaccttctattcgaagggtgtgcgtatatccattgggacggttcgtctctgtaccatctgcctgctgccctaatggaagtaaaagcagatgacaaaaaattcgttaacaaattcgtctttaataatatgatcgactatcgcgttgatgaaattatcttcatcaaagataatggccagaatggtggtattaactcccagatcacaggccagtctcgcgtagctaccgtgattaactcacttactaagcgtgagaaaatgcttgagttcaaggagaaattcctggacaacggtacggttattggtcttatcctagagacggatgaaatcctaaataaaaagctccgtgaacgtaaacaagaagagcttcagctggactataaccctagtaccggccaatcaactgtgctcattctagacggcgggatgaaggctaagccgtactcccaaatctcctcctttaaagatctcgattttgagaacgatatcgctcgttttaataaagacgtatgtatcgctctcggagtcccacaactattgatcgagtgggggtaacaacgctaatattcgaccgaacattgagctgttctactacatgactattgtgcctatgctcaataaagtatgtagctctcttacgttcttcttcggttttaaagtaacgcccaatactaaagacgtagtagcactaactcctgataaggagaaagaggctaaattcgtaactgcactagtcaacaacggtatccttaccggtaacgaaggtcgtatagagcttggttacgaggaactggctgacgagcagatgaagaaaattcgcatccctgccaacgtagctggatcagctacgggagtaagtggacaagaaggtggcgctcccaataaagacgaggaaaaagaatgattgactataaagcactaaaactgctattcccgaacggtctcccagaggcacacaacgtgtttgcaactgttaaggcgaatctcacttaccagcttctgcgtaaggagtacggctacgctgcgactaatcgtagaacctggaaacagtttgaggaagcctactcagaagcaactaagccggtaccggtagcctctgttagcatctctggagctcctgcatccttagattatattaagactgcacagctctccgcaactgttctacccgcagacgcagacaataaaaccgtaacttggaagaccagcgatgctaccctagctactgtgagtgcaacgggattagtgacggcactgtctaaagcaggcactgttaaaattactgccactgcaggcggtaaatctagcgaagtgtctatccaggtcaaagctcctgttgtagcggttaccggtgtcactatgtcacctaagactattacgatcgaagcaggtaagactggcaaacttactggtaccgtagccccagctaacgcaaccaataagtctgtaacttatacttctgctgatactaccaaagctaccgtagctgcggatggtacggtaactgttccctccaacttagctgcagatggtaccgtagttattactgttaaaacagctgacggcaataagaccgacactgctacagtaacagttaaggcggccactgcgcctgtataatacttgataacgtgggggagcttcggctccccatttttctatatgagtgtaaaaatttattctcagtgtaagtaatttcgactacctactaatcccacacaccgtatgggattttcaaatatcttttgacattcgcgatttggtatgtaataatagtatctgaaaactgaggaacaacacgaaagtgtttggagcaaacgatgcagaatattaatcttaatgctgagattaaatctgttaaagctgtcggtgagggtgataatcctcctttaaaaatcaaagggtatgctaacacgattaccaaagaccgcgccggcgacgttattctctccgaagcgtggactaccagtaacgccctcaagaattttatgaagaacccgatcatgcttttcggccataaccatagccgcccaattggtaagatcctagacctggtaccaaccgagtccggacttatggttgagggtgaggtaagtgctgctgatctacagatttactcattaatacgtgatgaggttcttaaaacgttctcggtaggcttctatatcaaagacgccgaatgggacgatatgactgaaacgttcattattaaagatctggagttactcgagatctctgtagtctcggttccctgcaaccaagactcaacttttagcctttcgaagtctgtaaaccataatgattacatggagcttcgtaagtcttttgtaaaatcttcgcaggtccagcctgttgaacaacctgaactttctaatttagagaaattcctagtagccgctggttacgctaaaggataatggagaaataataatgtcttacgatatcgcacaactgtctaaagatctgggcctgggtgacattgctgagcagcttaaaggtctaaccgcctctcagaaagctgaagaagctcgcaaatttgctgctgagcaggaagctaaagaactcaaacgtatggaagacctggttgccaaagcaactggtgaagaccgtaaaaacctggcagaagctctggagctacgtaaaaaacctggatgagaaatccaaacagtccgctgaagcgttcgttaaagcaatgaactcccagcaggaagaaatcactggtctgaaagaagaaatcaaatctctgctggccgctcgtgaaaataatcgctctttcgtagctgatggcgttgctaaggcaatgttcggtaagcaggaagacttcgaagacgaagttgagaaactggttcttctgtcctacgtaatgcagaaagatgtattcggtactaagcgtggcgaagcccacctgaaagctgttaacggctcttcttctatcgaagtttctaccgaagcgtacgaaaccatcttctccctgcgcatcctgcgtgacattcaggctaaactgattatcggtaccatgttcgaagaactgccgatgtctagcaaattgctgaccatgatggttgagccggaagctggtgaagctagctgggttgacgcctctacctacggtactcctgctactgttggtgcggaagacaaaaccaagctgtctgaaatcaccttcaagacttacaaactggctgctaaagcgtatatgaccgacgaaacagaagaagatgctatcttcactctgctgccgatcatgcgtcgtcgcctgattgaagctcacgctatcgcaatcgaaaaagacgttcctgaccggtactggtgctgctggtactccgaaaggtctgatccagttcgctaaagacgatggtaaagtagttgctactactgctaaagctgacggttctgttaaagttaccgccaaagaaattcacaagctgcgtcgttcactgggccgccacggtctggatctgaacaaactggctctggttgtttcgatggatgcttactacgatctgatcgaagatgaagagttccaggacgttgcacaggttaccgctaccaccgctatcaaactgcagggtcaggttggtcgcatctacggtctgccggtactggtttctgagttcttcccagctaaggctgcaagtgctgagttctgtgtagttgtttaccgtgacaacttcatcgttcctcgtcagcgtgcaatcactgttgagaaagagcgccaggctgaacgtcagcgcgatgcgtactacgttactcagcgtctgaacctgatgcgtttcttcgagaacggcgtagttgctggtgcttacgctgcttaatttggctatactgccgactaaaggagagcttcggctctccttttttatttgggtaaaatatgcaattcatgacagattctgattggagaacatatggaggccttaaacgtcctgacttagagtcgaatatcccaatgttaatcaaagcagctaatgctctgattactcagcttctaggtattgacgacactgctaacgttgtagacgttctgcctactaaaccagcacgcaaaaagtacttcctgtcttctcccgtgcctagcacgatcactaaaattacgattaacgatcaggagatcgataaatcgcaatataagaactacccggatggtacgctcttgctgaaattctcccctccagaggggtatatggaagtagagtttactcagaccggctttacctcgatccctgacgacctggtactagcagcatgcttcctagttgatcattgggtcaagaaggactaccgcgagtctcgtacatttggcggagaaaccgttactttcaataccactaaatctggcgtaccggaacacatccgtactataatcgaagtgtaccggaggctgtagtggcgttgggcgatctagctcgacagatagttaaagaacagctggacattatgagtggtggtagccactctaccaagaacaccgtgatatatagtgcggaaactatggataaccacaaagatggcaccataggcaaggtatccttccgatttaccaagccggtatcggaggatttactgaatgttcggacgtcctctattttaaaagctgtctcgtcgtcacttaatctggaaggtgacgttggtgttatcgataaccttctaaatagtatcactggtaaaaaatccaaaataggaagaaaacggtctaccggtagggtagaggttaactttggagatccttcagatgctgacaacggttacgctggtgctatttctggcgcttctgggcgtttcgtctcaaacacaaaccttagagcgttacttgaactcgtagcgaaagaatacttagtcaaggatatgaaaaaagctggggcacctcttaaatttagaacggggcgtttcgctaattccttgaagattaaagacgtgctgttaagagaagacgcaggggcaaagaatcctgacctcaacatcacgtataactacatgcttaagccttactctgtgttcaatcctgccgtctctacctaccgcggactttccttacggcctttccctggtgctaggaacccgcagaagctgatcggcgaggcaatcgctaaggctgcaagagaccttatccactctagataccggataagagtaaatcagggtacataatgaattacagaacaagtattgctgatgccctagtggaacgactgaagaaggacatggatgggagtaatcccacagagttcttcactaatatgtatgggaacgtatcccgccagacttattcgtttgagcagatcaatgagttcccttacatagcagtccacgtgggtaccgaaactggaaactacctgccgtctgcacagcagtgggtttaccttgaaattcctattcttatctatgataaagaaaaggatgatattaacatgcaacttgagaaactcatagcggatgtaaaaacctctattgacactggaggaaatttacaatatactataatgaaacctgatggttcaactatcgattctgaagccactgacatgcagatcacgtcggtgtccacagacgagggtatactgtccccgtttggttttgctcaagttaacgtaacagtccggtatatgcctctgagaagagcgctggatagataagttacagctcaggagaaatttaaatgtctgtacaactattacgtaatacacgaatcttcgtgtcaaccgttactacggggttcactaaggccaacacccaggagatcctagttcaggatgacgtctcctggagccaggacagtaactccactgatattaccctaaatgaggctggccctaagccgacccgcggttcgcagcgctttaacgattcattgaacgctgccgagtggagcttctccacttatatcctgccgtacgacgacgcaggtaaacagattctaccggactacctactgtggcacgggctgtcaactggcgctgccgtgaatctagcaggtactactggcgtattccagaatgctactaacctggttgtcaactttaaagacaacggatatcacgagctggccatgctgaacatctacatcctgaccgatagctcttggtctgtgatccgtaactgccaggttgggcaggctgaggttaacgtggatatcgatgatatcgggcgtgtaacctggtcaggcaacggcacccgtttagagactctgtccgcacagccgttcgatcctaaaaccattggtatagacgacgctctttatgctaagattcagagttcttatattaagaacaaactgaccattcttaagctgaagaacaacgctaccggcggaaaaacctataacatcccgatcacgggaggttctttcaccatgaacaacaacgtgacgtacctgactcctaacatcatgtctcgtgttgacgttccgatcggttcattcactggttccttcgagctgactggttccttgacagcgtatatgaatgatgctgccaacggctctatccagctgtacaaagatctggtttccgacctgaaagctgtgaacgacttcgaagttgcaatcatcctgggtggagagtatgatactgctcgtccggcagccgttctggtagctaagcacgctaacctgaatatcccgtcgatcgagaccgatgacgtgctgggtgtatctattgagttcaaggctatcccgtctcagatggatgctggtgatgaaggttacttaggtttctcttctaagtacaccaagacttcgatcgcgaaactgattagctctggtgacggtaacccagtcactccataaggataactaatgctatactccctaatgcgggagtctagagtagtcatcgagtacgatggcagggcgtatggatttgacgccctgtctgattacactgctggaacgtcctacgaagagtttaaggcaaatcgcaggacgattcacagacgcagtaactacgcctattcgaagataactgctcagtctccttcttcaatttctctagctcttaacttttctagcaatgctctcgaaggtctattcttcgagttgatggggtttatagaggtagacggaatgtatcagatgcccttgttcagtaataatattgagcctaaaatgttctccgtatatattattaacaagaacacgagcttacgtttcgataactgttttgctaccacctgtgacttttctctggataagagtgtcccggtgctaaacgttggtatcgagtcgggatactttgaggaagtaggccacccactcaacagctatacgcttgatcaaggtgaggtgctaccattttcattacctcaggtatcttcgaatgggagagtgctcccaggacttatgtcagccggtatgtcattccagcagcaatgcgaatggcggggtgacagaagtttattcgatatcaataagatttataataataggagggcaatcgttaacgaattgaactcatccgctttgatatcgatgtactatgcgaagagtcttcaaatagattctacgcataacattaaacctgatgttggcctaccggtacaaatcagaaataaatatattgtggtggactttccatccactaaaatcacaaaacgcctagacttaaccgacgtgtacaagatcgattacgacgtaattcctactgagcaatcagatcctgtccgaataaagctaattggagattaacaaatgagtattaacctgaaagacattgccctggacaccaaacagatcactaccgcgtacccaggcttaccgcactttaagctaaaaattaactacgtttcccgtaagctgtctaagaaaattctggaagctgcgcaggagacccagtttgttaacggtattgctgtaaaggttcagaatgacgataaattcgcagaagagttcgtcaaagtagcaattgaaggttgggaaggcctgacagtggctgatgttgaaaaactgatgcttatcgacgtgcctgaagaccgcctaggcgataaggtggagttcagcattgacaatgccgtaatgctggtacgtaactctagcgccttcgaaacctggatgaatagcaccgtcttccacctagacacttttcgtgactcaaaacaggaaccgactgcttaaggagattgacgccttcgcagaacgatgtgttaaaggaggagactccaaaataacaaaagagcagtatctaacgatgtgtgaatccttgggggaggaacccaatcccgatgttctcaaacggtttgtggagatacacgactttcctgaaatcgctcaaactgctcttacaatatataataacttatctgataattatattccaggagattatccaacctacttaggtaaagataagagtgtccctttttagttttcttcgatgtctacggtgtcgaggatccagatgagaagagtcttatactccaaatcatcaacatattcgactcacatgctgtggcagcctctcgcaaacgtgttgaagcagctattaagaagtctaaaatgaagtcttctagcagatagtgagttacattttcctccaacgggcgttccacgtgaggcttggcctagggttaatgccctaggccttttttatttggaaaaaatacatgacagatagactaatacgagagttacttgtagacatcaagcagcgtggtggatccaaagccgctaaacagatcagggatgttgaagctgccttggagagtgctactcaaagttccgaggggcgttaaccagagtctaggtaagctccctgcaacgttcactacagtggagcgttctgtatctaggactcagaaatctctggagaaactggcatcaactactagcttaaccaccctagcctcttctatcggtatgttagggactaagttcactgaatttgaggttggactagcgaagtctgtgttacggatcacgtcccagttaaataatattagcactagcgctgtaaaatgggtgttgatatcaccgctgcgatgacgtcgtcctctcctcacttagacaaagttaacaaaatcttagctgagctttctgccaacgctaaccaggcagcttcggcactctctaagatcaaagcaggtactaacctggctaatacctctacatccgttaataaactcggcgcatccatgactaagctaaaagcagatttggaagcctcggtatccggtatagaggccaacctaggacagttaagcagggctttcgcatctatgagcagtgttggtgggttaaacccactaggtaactctgtaaaaggcgttatcccacagctcaacctactggtaaaagcggctaatcaggtaaactcagctttagccaaaattcaagcagggcgaggagtactacagctacctaatcagtttaaagccattacacaatccttaaacgctttggaaaccaagctagcgtctacctcccaaatacttgagagagggttctctaaaggcttccaggatatggctactaaatctgcgtcttcctctacccggatgatcaataacttccagaaagtggttccagagctaaatggcaatagaggcggctgcaattagatccgctgctgcaatcgataagctgattgcaaaacgcattcgcttaggacaagcggggggcgggtggcggaggtgctgcaggttttaatatgggcactatggtagctgagatgaaccggatagtagctgctattgacgccatgggtaacaagatgaataccactatgtctgatatggccagaagcacagacaaagtgtccgacaagctgaccgaccttaacgcaggggttcgggacgtaaatacaggactaggtggcctaaactctacgttaaccggtaccggtagcgctgcaggaagagcatcaagggcgctgggcaatacctccgggtccgctcgtggtgctacaagaaacttcgcagccctagctatggtaactggacctatgccgcttttatatggtgcattggcatccaacctctacgtactgaaagcagcttttgatcagttaaagatgggggaccagctaaaccgtcttgagcagttcggttctattgtaggtgctaagacaggtacaccaattcaatcgctagcaatcgcactgcaggaagctactggttatgccgtatccttcgaggaggctatgcgccaggcgtctactgcggccgcatatggtttcgattctaaacagattggtgagtttgctctagttgcacgtagagccgcagccactctaggtgttgacatgacagatgcactcaaccgtgtaatcaagggtgtgtctaagcaggaaatcgaacttctggacgaactgggtgtaaccatccgtctgaatgatgcattcgccgaacatgttaaacaactaaacgcagctaacacgggtatgacttataacatacagagtctatcctcattccagaaacagcaagcgtatgcaaacgcagttgtagcagaatctactaagcgtttcggataccttgatgatgcactgcgtgctactccttgggaacagtttgctgcgaacgcagactctgcattacgtaaagttcagcaggcagcagctaagtatctcggacctgttattgcgtctataaacgcagtcgttttatcctctaaggcctctatttcctcagcagcagcagaagctcagaaggaatcaatcggcaagatggacgttaaagataacaacgccgtggtgatgaacctcgaagcatctcagaaaggattggatgacgctataaaggctaaggaagaagccagcaagagacttgcagcccttaataaggatatcttagagcgcgaatctaagatggacatggctactaagattgctgtgagtgccaactaccagggtctaggaaactccttcactctaggggcctccgaggctaacaaaaggtttacgcaagaaactgccgatatgcgtcgagaagcgtataagttgcaacaggaactagaggattcatctggggctatccagaagtggagagacgctagagacactgcactcgctaaaacgcagaaagggaaccctaacctagctaatcagcttaacataacgcagaacgtagaagcaagtgacgggatttacacctttaacaaggatgctttaggtggagcagtcgccataaacaaagagtacaacaatattaagaaaactgctggagacttgggtaacgatatccaaaacttcgcacaggattctaacacggcggctaaagccaccgcagctctgggggatgctcttaaagcagtggaagccctagcaggaggctctactgaaaaagctaaccagttaactaaggatctgaatcttgggtactcttctgtaacggaaatgaacaccgcttacaaggctatgaccaactaccagaagattgcgggggacgaagccaaatctaagctggaagtggaaaaacgtatagcagatgtttacgcatctactcgtaataaggataaggcggaagaagcaggtagagcactagagctacaacagctccagtccaagaaagctgctctgcaggcagtactggctacgaataaggacaacaaagccctacaaaaggaactaactattctcgaaacagaagagttcaagattaaaaaccagggcatggaatctactaagaaggagaagttctacaaggataagatagttggtattgacagggagatagctctactctctaaccgtactatgacagattctcagtataacgtggcgagccttaaactaaatctacaggtagagaaagatagactagctctgctgaagactcaggctgataaagagaaggaagctgaacagtctagacgtaacattgcttcgattgagcgggagatctggaaagagcagcttgatcgtaatgctaaaactgctgagatgcgtaaagaggaatttgagcgcaatcaaagcatgaagcctctaatgggcgaatcgcagaaaatgcaggagcagttagcgttctaccaggaaatgaaggaattcacgaaaggtaacgctgatgagcaggcacgttggagtcgtgagattgcaaataccgttgctcaaatggcagccctcaaagctcagcgtaacgcacagatgatggatcgtgtaggacagtcattgggcgcagactacacgcctactactggcctggaaggagaggataagaaattcgccgatatggaaaatcagatggcgtcatacgatacagctatcagtaagctctctcagctaaactcagaggctactgctactgctcaaagtatggggaacttagctaacgctatgatccagttctctcaaggatctctggatactacgtccatgattgcagcaggtatgcagacagtcagccagatgattagctacggtactaaccagcaaatttcagcaatcgatgcagctatcgcagcagagcagaagcgtgatggtaaatctgagcagtctaagaacaagatcaaaaagaatggaagcggagaagattaaacttcagcaggaatctgctaagaagcaaatcattatccagacagcagtagcggtaatgcaggcagcaacagctgttccgtatccgttctctattcctctgatgatcgcggctgggcttgcaggtgctttatctctagctcaggcatctagtgctaccggaatgaccgatatagcaggatctggtggtgaaaccgcctcttacctaaccttaggtgagcgccaagaaaaacgtagatgttagcatgggcgacaaacgcaggtgaactatcttacgttcgcggtgataaaggcataggtag

SEQ ID NO: 8 - DNA, 17247 bp, Klebsiella bacteriophage F105/15
ggtcttaacgttctcgacaggatagattttactattctcttcatcgaaaacttcatttaaaagttccatgacatatcctcgtttgtttattctatttatacgaaaaaggcccgaaggccttaattaattatcgttactgtacgccaaacttgtagtccatttacagactcatactcttcaatgttttctttgaagcttcttaatgtgttaatgttattaaactcaagaacttcggtgtgaacagaaatacctccacgcccatcaagacttttagcaatcacttcgtataatactttcattttattcctgttgcctctgtaaagttcacgccaaatgcagcttcgaatgtattagccacttctttatcatatctacgctgtttaatgataggtaagaataatcctactgtaccatcatcacgaccttcagcagttacccatccattgcattcaagttcccagatagttcctggaagagaatctctgtttttccatagatgagtacggtcaagctcgtgcagttcttcgggcttatctttaagacctgacccagcgttaacacgaatacgaccacattctgatacgaacattaagccgcccattttaccaggttgtttcctatgctcgtatgaaccgacacatttcaaatctacggtgataacctctttaaatttgacgaggttcttagaacgcttatcttcccaataagcaccgatattcttaaggataataccttcgagaccttggtctacgtatgtcttatagatagctcgagcttcatggatgttatgtacgacatggttttcaattagaataaccttgtcatagcctttgctcatcatttccaatgcacggaaacgtacatcataagcaaatccaggaactttaccttcggaatatactacatcaagcggaacataatcccaaacttggaatctcatgccttctgcttcttcggcagatattgttcctttaatggccttattagccaacccgtttgattccgtgcgagccgtctgttggaattccttagccttacttagctcaggaagctcaggctctttaaacatatcaaacaggtcgttttcttcttctttcacttcgacatgatataccaactcgccgtcaatcatcacaccactaggatgacgttcacgagcttctttggtcatctcgataagttgacgcttaagtttatctagacccaggtattcattaccggaacgagtaagaagagttacatcatctaattcatctccgcggatttcagcgaagcatcgagctccatcggctttaagctgagcaaatgcagggaacttaatatacgatagcgctttctcagaataagctgatgctaacatctgtggcatctcaggaattaatttcttccataccttattagcaatagaacccgaagcgccacaccgcatatccttaagaaggacacggaccagtacactagcatcaccctcgttcatcttagagagcaaatctactaacccctggattgccatattaccagtaagtactcgtgctgccagaatgtcttggaggtaatctagaccatctgagaatgtctttgaaggaacatttgaatatttaacgggagtatattccgggaccttcttaataaagaacttaaatcgtccggaatatgccagcagataagctcgttttaaatcaacgttatctttattgtcaacgagaatttgggttttggcttttgtgcctttagcttcttcaattgatttgatgatatcaaaaatcatttttcacctaattcgtttaagagttcatcaagcgtattatgataggttatgcctttgatatagacgaaaccattttctacgcactttttccaaactgggaattctttgactgctctccattctggattccagcgataaaattgattaacatgaccgtaatcacgagaattccagccgttcattgttttagtatgaactacaaacattattcctccttgggtatggccattataccatacccagagtgttagcaattaatttggtggttatcacatgtaatacgaccgttattccaccagtcgtttccaggaggaacgtgcggacctggactaaacggaatgataggctgtttccaccaatctcctggaacttgtcgtggaggccagttaaaaggaggagtgcttggtcctttacgaatctgctctttgatagcttcttcccacaacccggtaagagacttctgaggtttcttaacggattttagagattccaagcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcattcagattgaaacgacgattaaggttagcatctactgaattaccaagagccgtgatagcgacaaaatcgtatttttctttgagtcttattaactgtagctaaagcatcagcatacggtgcaaggtagcgaataaaatcgctgttgttatacttcagaagcagcttaacagctagttcttcttcacaatcaaacagctcagcgggtttaatgaatttttcagtagtcatcatatcaaggatatgctctacaggaaggttatatttttgggcaaagtaaggcagaccactttgccacttaacgatgattccatcaacatcggttgcgattacaggttttgacattcggggaaattcctcaatgcttgtttaaatttggcaacgctatttgcggcaccggtgaaattgaaccagattaaccctggagtgtccgaaggttctatatcaattaattctatattataatactcagcagtctttagcatttccctggtgatacgtcgggcaaccatatgaccgaagtgaggattaatagacatcgtcgttagcagcccttagttgagtaatcggataaagctcagattccgcatgaattgaacgattgccatcaacccaattaacttcataccaaggttcaaccgagtaggctttaatggctggagccgtatcacatacaactccaggaattccatttgctaatcttactgtactgaagatatgatatttcatacatcaagtctcactgcccattcgggcaattcaaagaaatccggagcatcaatttcatactcaacggtgtgttgtttaacatcagctgacatgatatcaaccattgggtggtttttcaaactgcaagaaaaaataaccagctttagatttaggcacggatacaatcatgttgatttcctcaaaatttagttatgaatttttctttcggcattttggcatttgagccatcactgtcagaatacccaattggcatagttgcattaatgaattcaattttagcatttataacattaatgctcagagaatctacaccatcaaccatacgaaattcaggagggcaatacttatcaatgtatgctttcacaccgtttttattggcaggtgtaccatcgcgagtatcgctgataatggtttcaacttttttctttcgtgaatcatagaaagctgatacaatcatttcaatttcctcttaaaacggacgaatattaacgtgaaccacagggacagcaaaaggttgcatgattacaacttttgtgtctttagttgcattcaggcgttgtacttttgcaagattaacagcttcttcctttgttaatccgccattgtaggtatcatttcctttatttgatgtccaaacgccccaatcattgcttccatcatcgtcggtcttcggttcaggttctttgtagatggtttcttcaaaataatgctgaaactcttgattagtaagaatacaccacatgtgagaaaagcgaacttcatctacactaacgcgtttatattccccatctggcttaatgatttcaaattcaactaatccggtattttccgcatatttaaaggttctggtaattttaatcggattattaccgatttgctcaaaaacacccttgataagagcgcctggagacaagattggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgataagataaatcacgtttacgaacttcatcatggaatccaactttgatttcagaaccgttgaactgaatatccagagtaggaccattttcaaagctgaagaatacgtagttatcttcccagtacatatcaatttgagctactgtaccattgttatgttcccaaagtaaagtagtagatacgtcccaagcattgttctgtacatatttgcggttgaagttagtgaagttcatttttattctccgtagtttgtttatctgtttgggtggtacaggtctatagtaacccagaccacccaagaagtaaacaacttttattcaaaaacttcagacatttttcacctctacagttttaacagtttttacttctgcaaatccgatgcttttaaacagttcatacttggtagtttctggaactatatcggttagttcaaggatgatttcttttgcttcttttaaagtgaagacgctacgcccatctttaaccactggagtaggtttaacgaacgttgatgggatttcaaaaactgcataacggtcatcagagctttggttttcaaacgctcctatttgcacaacccgtccttcttctaactcgtgagaagaaaataagcatgacagagaccggtcatattcatctcctatggtttttgccgaaatgattttaccagtttcggttttaatcttaacaacccggccatgcgaatcaagttctaacggcgtccagccttgaactccaacaacggtggcaatgagatagttaattgtgttcttagcgtctttccatctacggtaagtttctggggaaatgcaatatactcggtttttgctgtaattcatttttatatcctcaaagatggggctgaagccccagtcaagattactgtttagtccaattatccatgtttaatttaccgacctttttcatttgttcaattaaagcatcggcacgattacgaccgttttcataccaggttacatcttctgagtaaccgtcttcttcatctgtgtaggtttcagaacgaatacgaccaacaaccggagtgttaagaacatatactgaacctgtgaaccagtttgttaaagtgatatgccagcagaaatcatctgacggtccgtccggtgtcatgcatggaacgatatcaccttgaactttagacaaaatccacattttctcatggacagtctgagctttgtaaccgtcatggtctttagtcttgatagttgcgttcaggttgatggtattcattttattctccattgtccgtttgggtggtacaggtctatagtaaccttgttgagcctagaagtaaacaacttttttctattctgtggaaataaaaaagggaactcccgaaggagtccctgaacttatgctttcggcttccaaaacgagaagcatcatcgcgaagaaccgcacgagctcgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaaggggtacgtttaaactcttatctgttgcacaccgttagcttaaaggttccgggtccgatttatcggggataagatatacaccgatggatgtataggccttgaggcgtactcccgattggccatcgcctcgggatagcatgcacttgccgtttattttctagctgcactttggtagcaaatcaccgtggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttaagatgtttaaaccctttcagaacttccagtgcttctgcatagatatcgatggaagcaccatagttttcgtgaccggaattccatgcgttacgttggagttccagagctttagtaagttgtttgttcattgaatcgttcctcaaatgaggttaaaatttggtggacggtaaccgaggtttagctcgggcatccaccgcttagaattgctcgggtaactaattgtccgacgcccaattcatattattatttatatacgcatgcaagggacttataatgacaagtcacaaacttctgccgaatttctttgggtttcttcacacctgctgctactaacggatgaggtacatttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgtgcaggttcagatacgagaattacatactcgcctagagctttaattggaagttccatgtgttacctttgttgtttgaccatgtagttatattaacatggtcagtttaaagcaaattacttaccgatcatctgcagcagatgctcaactttcataccatttaccgagatcagtttatcaaaggtaaatgagcgccaaccttctttctcggtatcatataccggaagtgaagtagtgctttctgctcgggcagatttagtagtactttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccagcgttctactgagtatgatataacaacatcaccgcttagattaagtttattaatttcaacaattctaagtttcattattcaattccacagaattctttaatgttataccaattcaacttatccaaattacgttttggaacattgaacacctcgattccagcagaacgaagaatatcgtcccagccgggttcgttcttgtcgtatgtttcgcagtatactaattttttaataccagactgagcgatggcttttgcacaatctggacatggagacagtgtgacatacattgttgctccatcaatactactgccattccgggcagcaaaaagaatagcattaagctcagcatggatttcattgactttagaccaagccgagtgggctgctcggtgttctttaagcaatccgacctttttgatatggattccgtcttgacgcaatcccgtagatttgtaaggaatttcaccaatccaaccttgttctgctgcatggtcacaacagttcacaccaccagaaggtgaaccgttatagccagtagaaataattcgtccattcttttcaattactgcgccgactttccacgagcagcattttgactcttgagatacgagatacgcaatttgtagtaccgtcgacgctttcatttaaatcaccagataagttgtgttatttgttttaaccaattttaactcgtcggtaggagaagcaaaactctctactcgagaagtacgaatgcctgtaccatctggaaacggatgatttcctcgttcaagaacatcggaaaagacataaccatacataggttgtccttccttgacgttaacgttactaaacaaaatagcatcatattcttcgcgtggaattgaccaaacaccttggtcagaaccaatgacagcattaatcagacgaataccattctggctaatttctgccctaattccacgagcatgttcaattaaaagagcttctacagcctcacgtaaagtcattagatatgtcctaaaatgttagtcatttcaacttggcctgttccggttaaagccaattgagtgtgttgattgctctttccattattaactgtaatgatataagcatcaacatagttaaaggatgactctccgacgagagtcactttacttccaggaacccggtttgctacttcctgtgcgaagattttaaccttcgaaataaattcatcatgtgaaaatttagcgtcagacaacataagtcataacctgttgggtttcaaaattagcaataattccaacgataaaccaatcgtgttcaccttcgccacaagaaattttaacttcagatgaaccgcctgaccggtcaatagaaaatttaataacttcgccgtttggaataagtgcattcatggcagataaaaactactgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaaccacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaccagtagggtcttctttagtaccagactctcttccggaaacagtaagaattttatatcctttattacgaagcattttaagaaattcaattaccatttcctttggatggtctttaccacatttggccaagtcataaggagaacgatgattgttatctgctaacgtgccgtcaagatcaaagataactgcttttggcaatgattcgtctggaatgtacaaatcatatgggtgcatcttagaatagaagctacgaagcacttcaataggaactgcattcgcgccacgatagaggttacgattaagcaattcagtccaaggaacgtcaaagcgtttaatttcccacttgacatcgtcgaattcacatgacaactcttgccacttcttgatagtcgttggattaaggttagtatcagcaatgatgacacctttggtggtttccatctcaagcagagtcttcgccatagaaaactgacatacagatacggacttctcacgaagcttagaatatttgtaatcattacgtttatcaaggccaaagatgccttcacgcaaatcatcacgagacaaaacataccaacctggattagatgctacatattcgttagcccaggttgttttaccagagcctggagccccttgtgtcaaaatctaattttttcattatacatccttaagagtgtcaataaaatcatgaagagccttagacttttcattccaattagcacgattatttttctttaattgctcgcaatggcttattcatcgacagtatatctatttttgtcataattttcagctgcgcgtccaaacacgatgcacgccaattcattttcagcaattaaccctttaagtgtttcatactgttcttgattcattataataccatcacttaacgcaacgaggttctttaaggtcagaacgataataacatatcataaacgtaaaatgtcattcatccagatgcgatactcttgagactcttcaaacggcatacctacccaggctttaccgtcaattacttttacttcccaatgtccttcccatttttgaattgggtctggccactcaggatgtaaaaccgggacatccggtgcactagaagagcatccagtaagtaagctgataatacccatggctaatagacttcgtttcatctggtagcctcctggatatcttctgcaaacttattgaagcttgcattaatctgtttttctaactaatccaggtttagctgcgactacatttccacgcttagcatctttattcattttagcgttggaagtatcacgagctgctcggttttcctgatagcctttatatgttgtctgcagattttttattagaaacaccgatattttctatttcttttgcttgtcgatcagattcatcttggacgactttgaggtcagctttaagattttctacccgccacgaaagatattttaatccgcctgcggataatgctaacactccaatcatcaaccaagttgtgtttattttgagcatagtttaaggataacctctacgatatcatcacgggataatcccgaaatgaggatgtgacgatcagaactttctgaaggagaacacttgaagcaagcttctacatattctgccatctcagaataattaagctcgcgatgcataatgccaagacgatgcttgccataaatcgggtcaacgattacatagcatttgcatccgttagcatgaacgtttggctgggtgatgttcttgaacacctctgcaccatacttcgcgagatgattatctaggaaatcaatcatttcatctacggcttcaggaagggcttcggcacgctgctcgttcacacgattagtgtactctttttgcttcttacgagcagcttccttgcgcgccatgtgcgtccgtaggtcagtgacgaaccccaccttcttggtgccattccacacaaaaatcccatcagaatgagtaccatatttgttaacaaccatatctaaagtaattgcttgcatatccatttcaatatcctcatcagtttgtgtaagtttatagtatcacactctgacgaggatgtaaacaactattcttcagaaatttcaatttctttttcgtactcttttggaacatatcctgcccagtacttcaagaacactctttcgaggtctttaagcagtttatctacatctacagttccttcgtacatgttcatgataacaaccaaaaagatgacgctgattaaccgttgctttctgagcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcgtcggaatttgcagatacgacagacgcaaacagtctttcatttgacgttattgagtctttagtgtgatgaagagcagaataccattcggtcttaaccttaaatctctgtccagtgtttagaactgcaatgtacccttctacgccttcaagttcacgaacaccttcaacccaagttgtgggatcagaaattccgtaagcattaattaaataaggacgaatcttagcattagcgtacaaatcatcatatttaatatactcgccagttgtgttattacggacgtttaacacaaacagctgtggctcctgatatgctaaaacaacgcgattattaggtgaaacaaattccatgtttaccgtataaccatctagcgctagctcaagaataacctgatgaagcgaagaatattcttcactgttaagcaaagctgaagcttgtcttgcctggtcactgtaaagagtaggtttttgatttaaggtatagatacccatcatcaacataagatgatactagagagccatcagccttatccataatgtattctacatcgctaatatcaattcccatcgttaatgggttttcattcaaattaaagaacttttccatcggacgagaagcaactcgaattggggtatcgccatccatctcaaacatgataccgcgacattcgagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgttgtgtgttccatggaggattgaactttttaatcagaagcggttcttccaagtccatagtggatattgacatctcgccaagttcattattaatcaaaagattaaaacactgacgagcatagaactcttacttttttgccagccattagtgcttcaaaaatcttggcagatttagccgaatcagaggtttggtctttccgattaatagcagttctataataatttatacgtttacgaagatttttagtcttaccaatgtaaactagttcatcatcaactgcgatggcataaactacattcaacttgtttgctatcaaaattggtttgattgtaaaatctggttctaactcaagttgaacatattttataaaagaaaactcgttagcaatatcattcataataaagaggggccgaagcccttccttataagtactttttaaattccaattagaacatcatcagtgacatcattgtcaatctgagctaccagataagaacttatctcaacttcctgaggagcagattggactgcgtcagagttaagatattcgcgaatccaaggaataggatgtcgagttggtgcatcagtaatcggacaaggaagaccacaactacgcatacgagatacagtcagatagtcaatgaagtcatgaagaattttaacattcagacccggaagaccaccattgcggaaaagatgaatagcccaatctttttcttggcggttaacttccatgaagatttcaattgcttcttgttcacactctttagcaatctcaacccattcttcgccatcagtgccagtttgaagttgacgcagaatgtactgtgtgcccttcagatgaagctgttcatcacgagcaatgaacttcatgattttagcattaccttccatgatttccattatttttatggaagttgaaggtacatgcaaaactaacatagaaacgaatagcttctagcgcgttaataacatgtaaacaaagataaagagatttcattaaatcacgtttagcttctttaatttcgatattatcttgattaaagcagcgatttttggcattttcccatgcgcgagtcttcgctataacatcatcatagtaaacaccgattgactcagcgcgtttcatgattgcttcgtcaagaacgatttcatcaaaaattttaagctgggtctacataaaggttacgcatgatatgcgtgtatgaacgactgtgaatagtttcgctgaatgtccaagtctgattccaagtatctaggcttgggtcagaaataagcgcagataaaactgctgctggagctcgtccttgaattgaatcaagaagagattgatatttcaagttatcagtgaagatattgcgttgatgttctgggagtttttcaaactgaccacggtccatcataacgttaacttcttcaggacgccagaagaaactcaactgcttctcaatgagttcctcgaatactttatgacgctgaatatcataacgcgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccaccgaagtaccagaaataaagcaagtcgtccatcattacagacatttctactttacctttagggaaattcgccgggtcgtaataagtattagcagagatgctttggtcaacaaatttctgcataatcagaacttggttcagataaggcttattaccctgtttcgcgagctgccaggcataatcataaagggaagcattgtgttcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgaggtcttctcgcaggagttcccagtcacagacatagtttggagctgcgagttggtcaattctttcgttgtaccaatcaataggcagttcaccacgtccgtatcgtgtttctttgtaaagcgtgcacggacctttttcgctagcaagtttaacggaggctttgatgagtgcatattgaatacgttccatcatttcatgggtaatatcattagcatctgcgtatgaagcaaagttgcttgctaaccaagctgcatagttagtaatgccaacacctaatgctcggcggtctttagcttttaacgctttgtctactggatagtcttggtaatccaaaaggttatccaaagctcttaccattacttctgcgatttcgttaacttcttcttggtcttgccagttgaagttgtcgagtacgaatgctgcgagtgtacacagcgcgatttcgccatcttcttggccaacatccgaagttggtaacgcaatttcgaggcagaggtttgattgcttaaccgtagccatatcacgaataaaaggaccatattcaccaacgttatctaccatgtacgggtaaattcgagcagtaccagcacgttcagtaaggaacaactcaaacagttcacgagctttaatacgtttctttcttatatctggattcttttccagttcttcatataatgtacggaacgcttgagcatcacggaagtattctgtgtacaaggtaccaagacacacatcgggactaaacagagtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgtttccagaaaggaataactccagtatgtttgacttcaccgaatccaatttttgaaccctctgcgcgaatcattccagcattaataccaatacctgcgcgcttactgatgtatttcgtaattgatgcagcagcttcgttaattgaattaagactatcaccgccttcaataaccacacatgaactaaactgacgtgtcggagtacgaacaccagacataataggagttggcaacgaaattttcttagtagaaactgcatcatagaaacgaataacgtttgctaaacggttttcaccatcatcttggtgcaagcacataccgatcagcataaaggcaaactgaggagtttcatacaattcacctgtatgacggtcttttacgagatatttctcgataagctgcatcgttcccgcataagtcatagtgaaatcacgctcgtgcttaatgtaagaatcaagcaaagtaatttcttccgcagaccacttactcagaatttctttatcatacttatttgcattaacacaccgggaaatgtggtcaataaaggcaggtggttcaaactgtccataaacacgtttacggatttcaaacatcgctgcattggatgctacatattgataatctggctcatcaatagaaatgctattcgccgctaccttaacgatagtcttttggatatctgcagtgctcatgccatcacgtagatgggatttaataatttcatataactcgtatgggtctactttagttccttcgcatgcccattcgaggactttaatgattttctgcatgtcaaattcttgactaacacctgagctcttaattacttgcataagtcctctaattcaaatgtatctttaaaaagtttattcactacaagagctattatatcaccatggcaaggaagcggtttgcaggtgcatcctaatctcattcctcttaaagtttctaagtgctctcgctttatttctccgttccgaatcttagcaataaaatcgtccttaaacgcagcaatagcatcaggacgattatcgcaatctttaccgacgtaatttccccacattgttccgcgttggatatttacatcgaagtcggaatggtatttattaaccacccgacatatcttcatgttatatcaacttcaaaccaacagattaattgtgttttgcctatagaccattcatatgatttaacaatagacagaaccctttgttcgatcccgtacaaaaactatcttgtcattaacttcaggcaaatcgctagagaatgcatcacacatctcgcctaatattgtttgtcctttacgaataaatcgaatattcatacagccattttccccttaattgttgggtgagattcatatccaactaattcaaagtggtgtggacgtgcaaactgctctaaccaacgaacctgagaaccggtctgccatgtttcatacgtatccggaaatgctattttaagttcgcataactctttaggttctcggcggagaatttctttgcattgctcaatgtgattcatgtaaatgtgagtattaccaccagtgaataccaaatgaccaggtttaagattggtcattttagcaataacatgaatcaatgcagcatacgaagcaatgttaaatggaagacccaagaacacatcaacagaacgctgataccactgaaggtctaaatatccattgcgaacgttgaactgatacatcatatgacacggtggcaatgccatccggttcaaatcaattgggttccaagcagtcacaatctgac

SEQ ID NO: 9 - DNA, 10090 bp, Klebsiella bacteriophage F134/15
caaaaatttccatcaatcaatactcccaaaatacacgattgagaaacgcagatacagcctgatcaacggtcagaccattagacttcatcatacccgcaggaatgttagggaacaactctttatgccgctctcggtgagagttgacgcgcttccatttctccaggacgagttcgtgtttgaagtcttcacccccattgcgagaactcacacgcgccaggcatacttccttgggggtatccaagaacagaaccacaaggcggcgggtcgggcggtttagacgttcaatccacgtattgagcaaggtagcagggataataccttcaaagatcacatcatacccgatgtattcaggttgctcggtgatagacacggcgaatagcatctgctctgtgtcttttagagagtcaacccctttagatttagatttgtcatatttgccgacacagatgatattaaatgatgggcaaacggtcagcatcaccttaccattgtgggtcacgacatatgcctgaggatcattctccgccatccaggacggaacggtagacttgccactaccgttggagcctttgacataataaagctctcctcttgccggatattccccgacaacggtaggcggtttatggaacaaatggacaggtcttttcaacagacctttgatcgtataagacatacaaagccccaataaacaaaagaggctgctattatagcagccccttcgtctattgaacggaatctgatttaaaatcagcctgcgtttttggcttcttccagaacgcccggcaaccattcattgatcgctttaaccagagattccgcatcggtctctttgattttctggcgtttggtgaaagatttacctttcacgtacagactgaaaccccagccgccggaagtgatcggcgccagatcgacgtaggtgttagtccgcgcatgcgggttttctttatcagccaggtcggtgaccgggaactggaaccagcgcatatccggattgacatagctcaggtaaacacccggaatgacgcctgcttctactgctgccaggatcgcgccgaaattggaagaacgtgcggcttcaaccatttcttcgcgtttgttatggcgacgtttgcgatcttccggcgcaactgccggggtcaggttggtcagcttagatttcgcggccagggaagcgtcttcggcggcattgctaccttcggccagcgcttctgcgacgttagtgcccaggatacggcggcggacttcatctgcgtttgccacagcttctacttcctgcgggtcagcctgttcagctagtttccgtagattcttcggaatttgcagtttgttccgcttccggctggtcaacggtttcttcagcgtcaataaccggagtggcatcgccagcgccttctttcacgccagcaacgtcagtcggctggacttcttcggccttcgcacggtcgagagcctccagggtttcttcctgctcttcttgagacagggaatcgatcagctcaaacccgttggcactttgcaggacgccgtcgagcatacggcggatggttacgttaccgatcagcagaccagcgtctttgatttcggactggacgtcagacgcagttttaccttcaatatcaaatttcaggccggactcaatatggagaatgtaagacatagtgtagatcctatatgttgtaaatcggtcggctgacaaagccgtttcgcttgttttcaactatactgtagttttgaagattgtaaaccactttctataaaaagaatgttcagataacaaactttcttcacaaccctctatctgaaagagttcgcttcatcataaaccacatcgtctatattgtaaaactttttcggcaggccagcatggtgttatctctacctgagaaaatgccggggcacaatatttacccgcctggttgtcatacagactgtgctctatgttggccaggagcagatcgtcgtcaacgacttcaactgaatggatcgttatctggtgatcatacaagaggaagtcgtcaatgtgctcgtttcctgaacggagatgttgtaagatataaaattctatcaatgattctagaactgtattaagcctcaaataccttctcatagacatctccaggtgcgcggcagattattttttattcaaagaaattgggcatttcgcttggttcggtcaatctgaaatcacttcctgcgatcacgtgttcacgaatttggcgaactttggattcgaaatgctcttcttgcataatcaaagcgatagcgacatataacgaatcattaattttgccgaagaacttcgtaagagtacggcaaacttcgtcagtgtaaaccaggtcagggtggatcttgaacccctgggtgccaaccgaaaaagatattgcgttccttgacgatatgaacttcattggattcaatcgcgtcacgcaggttagaatcacggttttcagaatccactaacctcaaatcggattcaccaagagctgataacagatcgtccctgaagaattcaattgtttggcttcttgaacagagatattcaaccgcatatgaaaaacaacccaacgttttgttagccttattcttcaaatcactggagtgcgaccatcctgtgataaaatcctgcacgaagtcgattgtttcactatcgcctatacgcagcaggtctttcatatcatattcagcttctgaatcttcgctgattcccatagcacgaatcatggaagcaaaagttgggggcgactttaccgttttttgttagaaagaatcccggccgatttcaaaaccagtctttcctttagataacggatgtgttgcgtcaagacgagctggtgtaaattcaataccgagaatacgataaatagtagacattgtaaagcctcattgttgaagggaacccgttcgcgaattatcgctgcaaacgggttatagaactaatcactttttgggttttatggcgcatgcgagcatccttccagacgctggcctggctttgtttctggaagcgtgcagtacgcataaagaggacaacttcccaatattgtggttcgatttcataaagctgtgttctgaaccgatcagccctgtaaagtttgacacaatgttcatacagaggatggttggcgaaccgtttcaatgcatcccacgttagtcgcaaacgggttttggaacgatatgccctttcattcctcagtttaatcagatcttcaaataccaaaagtcggagttttggcggaagataatgaaggttaagcccccacaaataagtcacgccacgctcaccaaaattaatcccactcccccttggcaaaattaaaagaaaaataccaagggatacatgtcccagtatggcaactcttcttttgtcagggcatcatatttgaaatagaacatgcgtccgatcatatagcggacaccctgtaccgggcgcttgttctcagcaaatgctttcatcatatgctgtggggtcaggttggcatccttagacacacgttccatgaaccacacgtgggagcggcgaatattacgcttggcttcggccccgaagtgctggcggtactttcggatgtagcgcttcaccaattcgggagcatccatttcggctggaagcagcagcggatcttcttcacccatcgcattctttgccatttgtcaactcctataaataccttcagatctattatttaagtggagtcctcatcgtggaagactatcgcaattttattacacagatgttgcagcgcggtctgtcaaggaagaacagattccaggtgactatccccttgcctgcaggcatctttgactctaatgctacattagccaatgatggtcaagcgtacacctcagatacaacgtcatttggtgacttgttccgttccacagcgcgtatcgtaaacgcattctttggagggacaaaccaaacttctcgttctctccaaatgatgtgtatggtcgcttcattacctggtgtcggtatcgacacgacacctatgaataataacggcaaccatatcaaaatgccgaataacaaatcaaacgttgatttggaactctcattccttttggccaatgattattatgaaaagtctgttatggacaaatggaagaatttaatcttcgatcctcttactacaaagatgggttattacgaagattttgtaaccgatatttgcattgaacaattggacacagaagatcaggttgtccatcgggtttatattgttgaagcgcatcctgtaaacttctcgtctattgaacttgacaaaggcgccacagatcaatttaaccaatacaatatttcattctcatacaacaaagtcctatcggagacagaatatgaaacacgcagcctcgccagcgactttcttcctctgggtattgctgatgctcttgcttccggagattgggaaaccgctgcgtcaaaggccgggcagctttataagaagctcgagcaaggcaacttcacgggtgaagcccttcttgcctacaagcaactcgatcaattggtaaacaatatggcgggaataagcctggccgacttcgagcgcatctctatcggcatccagagggatattctcggcaatgacaacctgacggcatctgaaaagagtagtctgttggggatgttgaagagagtcggcagtaattaaaaagcccccgaaaggggcttttcttatttgtcgttaccacttacggtagtcaactttttgtattctaggcgggcggtatattcaaacgcccgatagatgacaattgcgatagcatacaacacagcggttataatatgtcctgtcaacgccactacaacgaatatgatcgttgactctgtattacgccacgcatatgatgtctttcgacccaataatttttcttgctccagaatggatttaccaccttccgccaaagtgaacaaaagaaatatagataacaatatcaacaatacgatgttgacgtaaaccagcgccaccccaagaccatcaaatggtgggattccgatatcgacataaccggaaaccagggacacaacaaccaggatagatatcagaatagagaaaatttttacgttagatgaatttcatgatataggatctcgataaaagacccccgaacggggcgtttgtgttgttattcacgtttcaggaattgctcgaactcgtccagagacgatgtatgcttagcatcagcgccagtagaagaaggagtctgaacgctctgctgcgcttgcgacggctgagactgctgctggttcaggctatcctgggccgtcgggcgttgcggttcctgatgtaccggagccgtagcgacagttgctgcaccactttctaccagtggctggctgtccgggatagccagggctttacgcagacgcttttccagttcttcgtacgatttgaagttggccgggttgaagaactcaaacaggctgtgttctttttcccagatgtcttctttgtacttgtcgccttcttcaccttcgccgcccagggaagaaactgcatcccatttcacgttatccattagtgggacgagaccttcccaattcccgaatttgcgtttctcaccaaccaggttaagaatcaggttggcgccgccccacatatcaaacggatcaaacttcggatcagtagcgaatttcgggttctgggccgcgtctaaaaatttcttaatcgccgggccgaattccagcaggaatactttgccgttgttttctggggagttaacatccttgatcaccagaatgttggcataatacttggtgttcgggagacgacctttgagaacttctttcagtttttcgtcgttggtctccttttgttgcgcccacagcggacgatcatgatcacgcaccggatcttcgtggccgaaggtctgaggagagttttcgatgtaccagccgcccttaccttggaaggaatgacgcatgatcatcgcaaccggagtaagaatctgctcagcatcgatcttgccttcttcctgtgctttcagatctaccagcgggatagggagaaaacggatgatgttttcggaaataccttccttgttccaggtccatttccagatacgcggatcctttgctgcagccgaacgctggccctgttgttccagacgtttttgcagagcgtcagattgctgaccacgggattgcttcagacgatcaaataagctagacattctttctttcctcgatagtatcgccccagggggctattctgtacacattatttctttcacagcgggagtaattatacccccgcatatttgattgatttaaccgcgaagtaattgttctttcgggttaatctcaatgatatcgaacacgtcagacaaagtgcgtttggcatcggtgtgggtatggtattccacgacatacacaccgccttccggagtcgtgaatttgatccggtcagtttggtcttcgtgctcgttaagactacccacacgccagcgggtaacaccaggcaagaagccttgggccttaatcaatttgtagacttgttctttagtcattttaacaacctataaaattttcttggatttcagttcacctttcaacaaacgagcatcagcgcactcagctgttaaacgggataacagaggcggtgtaatcatcttgcgaatcttagattcctcgatatcatactcttcgcacacgctggccattgtttccaggaggtctttccctggtggtctgcgcgcgcatcaataccatctctgaaaatgaatcaggcgtcaacacctgagcgatttgtccgtcagacatcgattgtgttccccttacccgatgtcttcttgatctgccgaagaacatctttgaacccgtccggagcagattgaggaccacggacaccggaaacgatttttggagcgccaattaccatagaaatctgaccaccacattcgctgcagggatcaagttcaggagtatggcgctcagcacaggtcttgcgctggctgaaagaatgaccacatcctttgcatgcataatcatagaacggcatggatggcctccattacatatcgtacaaataagataaccgcaaacagcattgtggaaaacaaaacgattgtgaccgagcgttcgcgtaaatgaacatatttggacagatattcgctctgttgagcagcccgaatattctggtcttcatgcggtgtcacagaataatacgatatttgcatcgccaacgaagacaagaatgtcagcatcgcctttaaccaaacgaacgcagtcgccatcaataatgcgaacgtgataatattcgctaataaccaataatcaaccattgtgcacctcagaattaaattcgggatgattctctttgaaagcagaaccgcctaccatattggcaaacccatcgacaagatcatcgattggcttcggatctttaacttccaacatatccattataccgcgcatgttaacgttgaacagcttctcgaagtgggctatcatagcaagtttgtcagcagtgcccttacctgtgaaattctttttggtataagaaggagtgatgatttcgaattccatattattacggcgcattgcttgcttcaaaagagaagtgttctcagcggtttggcatatattattggagttcttagagttgcccatcgcataaccctcgagggttatgaaatcaggtttctctgtaagaagaacagcttctgcccatttggaaatgttatagaatctttcttcaggggaggaatatgcaggttgcttcataatgctgatgttcggccgaatagggcgacaatatttttctaccgtgtaatatgcatagaagcgaagggaattaaattccaaaggatctttgtcgtcccagacacaaatcgccgggcaaccataagagtagtcaattccgcaatatttcataaaaaatacccataacatagtttcattggtgttatgggtatttagaccgatttatcgggtgacgattttgctatccggcaggatcaggcgcggcttgatgctttcctgctctttctgcatttcacggatggtgttcagcagaacactagtttcaacgtggcgtttcactttacgtgcttcatcgccataagcgatctgtccctgaggatccacataatggccggtacagataagcagtttgtacccgatttcactgatcgcttcgttaatgtccatcacttcagaacagagggattcggcttcaacacccatgttcggcgaataacgaacagaaccgctttccaggatttctttatcgatcatgatcatcccggcgacggtttggatgaccggattacccatgtcgtcgatttggaattcatcgaaaataccttcaaaccctggcgcaacttcacctttatcgttggtgacaacggcctttaggcgattgatgataactgttttcaactgctcaagatcggcgcgtttttcgttttgcattactattctccagttcgtagtctcgttctttcacatattcatatacacgggaattgatttgttggctattgccagtcgtacttttaacaacccaaccacttgtgaggacatccataataacggacgcttggccttcttgaaaataacttttaatcgtttgaaggcgtcttcttttatgaaaatacggaatgatctccccgatcacaatgcaatcgggataatatttgtgtaatgtttcaatattcctgtgtacacccacgggtataacgtcttcatcctgaataggactatagacaggatctacgacaatgacattaaatccatatctcaataaatcttttgttcccagtttaccaaatttcatgtcatctttagacattgcgatggtgtctacacccaaatgtctcgcataatccgacaggaataaatagaaatcagtaccagcatcaggatgaagtattgtcaattgctctccgatctggctaaaacagaaaccatgcattttcgttcctcactataaatatctgtacaatataccgtggagatacattatgaatttaccatcattgcctcgtacagaaagaacgctcaaaagccaattttggcctactgtcatcaagtatcgcgcgtttactgcggggcaacaaacttctttacttcaggtggctgacccaaacactcctgatgatgaacgtatcgcaacgatggaatcattattttcgtcttgtgtagacgctggggttccattttccaaactcccaatcggtgttgtagaagaagttttccttcggatgcgttgtatatcaatcggtgaagtaatgaaaatccggtacaaatgcaacaatcagatcaaagttccttcggttgatcctgattatcctggggacgaatttagaagcatgcggtcaagaactcgttgtgcctactccccctggacaaggtggcggcgcggggcgtggaaggtttcacagagtgtttcgacctgccgggtggctatcacatcaagatgcgtcaaccatccttctctgatgctggagtgcttcagaaagtggtttctatcgaagagagcattgctacattcatcgattgtttgtatgacgatgacggtcaggtttggcggtttgatgaccctaacgaaccgggtattgatcctcaggtagcagttgctcgtaagaaaactcgtgatgagtttgtacaatgggttggtgataacctggaaacggatattatccagaaaattaaagacgatttcttttccaaaataccgcgcatccattttgaaaccaagattaagtgtcctggttgcggtaaagagcataagatcgaatttaatagtcttgaagagattttcatttaatttttgtaaattgatttattatcctacttcgtgatgtgtgacgattaaagtcacaaggctatagcatatttgaaataagcgaattaatgccctggcatcttgatatgcttacagagacattgaaagctcgtcttgctaaaaagaaccaaaaccccgcatgagcggggtttttattgcttatttgttttacaggtctatttgttgtttcttgaacgcaatttcttataatgtcattgttcctgaacaaactcctggcttctaagctattgaatgttcaggatggaataaaaatacgtttttcttaaggacattct

SEQ ID NO: 10 - DNA, 32105 bp, Klebsiella bacteriophage F141/15
gcctacctgtaccggcttatgcatcctccagtgcttgcagccgagcatccacgccacgggccaagaacagcgctaactggtccatgcggaagctgtatcggtccccgcccggggatagtgctaatgacctcaccggtctcatcgttgagctctacctgctcatcccaggaatcataacagataaacccgtaattgaatgggtccagcccgtgctcctgcataatctccatggccttctgtactgtggtaccgcagtgctccctagcgtcctctcccttattgtctacactatcaacccaccggaagaaaccaatctccgaactaaggtcacgggcagctgcaatttcagctgcgctcataggccgaacgtctgttttctagccgtgcatccgaggtgttgatagtaccggtagcagcaaagatagtccctaaccgattgctggcagaaccagcattcttaatgccatcctctactggcactataccgaaggtgtcaatattccaatcagtagtacgcagacgagtaaaggagtaagtagggctacctaaagacactgtaccaccagtatacggacgaaacagtacgtcccctagcatacctactccagcaccattttggttctgcatacctacgttagcagccgctaccgacttaatcacctctccattgtaggagaactgccacacactccgggtaccgggtctgctcgccgactgcgcgcgccttcccagaatccagcccagtgccgcgccgttctgtattgaccagatagcaccggcactggtgcctcgaatgttcaacaactccatgccagtgttcccggagttgttcaggtcaaactgccgagggtacaaagcagagcttaacagcgcatcaccaccgtcaaagttggcttgtgggtaagcactgttgagccacatgaacgccactgggcgtgtagcagtgtcggtagtaccatccaccacggtgttgatggcggaaatactgtgcagactcccgaaactctggtaccagtactgacccactacccgcagcgtaacagcagcctcaacagtcatgtccccgttgcagccacggccctgggccttgtcgatgtgcatgagatagcaggttcttgcgtcactgccgaaccagttaatctcgtgcttgttgttatagacgttggcaatgtactcgtaaggcatcgaacttggacgaatggcgtttcgtgaaccgtcatcccacatgcgcataccgatacccccgtaggagttaatctgcgccatgcagtcagtgaacgagttgccatgaaacgagttgttgcctaagctaacctggtagtcaatatcaatatcagagttaaagaaacgcacgcgcgtcatgcggttaaactctgtaaagtcaccctgtgtaaaagtattggcggtgtcgttagggccctgcagcttattccataagtgcagcccgcggtggaatcgcccaatgtgtacatcggttaccggtacgaaacagcagccctgtaacagtacaccagtacctttggctgtactgttgtagtctacccacacttttggctctatggcgataccggacagtgctcgcggagagtgagtaccccaaccaccacgggcagatacacacggcgtgtactcatcctgggcatcgaatactaggatagagctgtacggcccgtcgccgtataagtgcacaccctgagtgatgcccctccagtaatccctggtaccctcaccagaggtaaaactagtaccgcctaggttgagttcgccggtaataaggcactgcccaccaggaacgtagacattccgaatacctttagatatagcagcatcaatagctgccctgaatgcggcggtgttatccgtaccagtttgtgtattggtatcgtagtcagcgacagcgccgaaatccagaacgcatagggtgtcgtctagcttactacccagcaaccgctgcacggagctcaagctgtggatatacgttccgagccactccgctacccgtgtaagttttactaaagccatagtatctccgtttatcgtttcaattcagccagcgctgtgctcacgttcttatactggttcccaatggctttgctctgccactgcctgcgctcccacagaccccagcacactttattgcgctgcccgttgatgtactgggagcagtcgaaggtccagcggttactgcccctgtatacccaaccagtgcctggggacttctgctggtacttgctaatataacgccagtccagtacagctctacccgccgccgcataatccaggttctttagatgccgctttacggcgctgccgttgaagccagctacgcctacgttataaatgaagtctatggacccaaccatagctacgtcagagagctgcataggaagcccatcaagagcttttgcgtgttccccagctgattgtatcaattgcttctgacaatcgctcagcgtagctctctggcccattttgacgccctttgtctccccatagcagattgtagggataccagcgctatccttataggcggtaaggctcaacccctcgttgtgctgaattactccggtaatagcaccaccaagcatagtggcccccgtaagggccgcaataaccttagtccttaaactcatatttaatagtccccttacgtgcctgctcctctaggagcttgaatgtacgccgcttatagtacgcattccacgccagggctagcactgcgcataccgtcgcagtgatgaagctgatagtgctccagttccagctcattaactctgccaaccaacctcctgataccgtagcgccggtaactgctgcacctgcccgggtagcgaggtctgccccaacccgtgtctcccaccttaatcatcctgctgccccttcttcctgaatagcttacgaatcaccagaatggccactaggaagaccagaggaatactggctccagctaatccggcgaggataagactgtaactatcattgttaaccacctgcaggcgctctgcctggattgtgccggtactaatagtctgcacttgcttcttgctagaagtatccagggtgcccacgttagaatcctgtacatcagttttgttggtggtgctggagtccaccttgttattcaagccaacggtttgcttggtattctcggcaccaacctgagcagatacatctggcttagaaccaactaagccggtgagtgcagaggtcgccgagcaaccagtcagagtaaccgcgagcagtaacccagcgaccagtttatgcattagcttgccgccttcactgcggctaccgcggcttcgagcgcagcaatcttggtatcgaaggcggcaccagtctgagccacatcctgcggctgcgtaaggatggtgtacaggtccttactgagaatgttcagctgacgcagcagttcctgctgttgcgctggggttgcttttgcaattgccatgtgtactctccttattctgccgcgtcagtagcggctacgaacgcactctgcagtgcagtgaacgaatcatcaaacgctgtaccagaaccctcaccgagcggcatacctgtacccgtaagggctacgtagccagtcttagagagctgcgacagcatgctgaacaggcgcgcctgcagcgtaccgtcatccttaaaggctgtaccggcacgagtagccgtataaccctgggactgcatgtacgtgaagaacgtgttcagcttagtcagggcagtcgtacctacgaaacctacgttgtagtccggctgcacctgcttctccaggttctggcacgtgcctacaatggcgtactggacgtccgcagttttagctgcgatgattgatgccattatcttcttcctctatgttgtttacctctgccgcggttctgcagccgagcagctacaccccgaaggcccttagacactttgctctgtgcccaatccagcgggttctcaatgaaggcccgagccagcttctcagactcacgctcagctactactttctcatcttccaccagatgcccgttcagcgtagccaccatcatagcgattgcgtctgctcggtcatccttagccaggctaccgcggtcgtacgttatgccggacaactgcgcgaacgcagagtacagccagcgtctatcgcgggagtacgccatacaggtgctgatatcgtcgtgaatagcacgctcatgcaccaccaggcgatggcgacgagtaacggggctgattgtgtcgattatacgacgctctttctgcgtggagttgttcaggtcccttacgccgataccggcgagacgtcgctcccgcagccggttcaggataagcatagacacggtaccgtgccccatgttgctctccaccaccatatccgggatgtccaactctacgcacaggtcaatcagtttatcaatgttctcttcgctgatacctccttggaagccacccactgagaataggtgaatgtacgagttcgcagccacccccagcagcgtaggacacttccgtccccaccacagccagccgggtccaccaccagcaccttatgctggtacggcaagtgcatactccccgtagaatgccgggaagtacatctgctggcccataactcccctcatgctcgtgctggtacaagtaccggcggtccgcaatgtaggagaacgtctccggggaggagtcctggctgccagagtaaaccagcatatccgacagcttgatacgggtacgcatctggtcagacagggtcgtgtcgagcatgtactgcagctggaagccttctggaccgaagtccagctccttctcaatcagcgcatcctcgtcgtagcgacccttatcggtactctcccctaacgtcccgtcaacgccgaagccggtgcgtttactaaccccgctcaatgagctgcagtatataaggagcaagtgtacttccatatcgttcttccatttcaacagacgggatgcgtccaggccacactcggacctcgaagccacgccccggcaaggtcttatagatactgtccttggtctgtggtgtacccaggtacagcgtatccccgtgcgtacagatagccgcgaagtctttcgaaatcatcagcagctgctcgcgctgggtttgtgtcaaaccgttcttggtggtctcgatatcatctggaatcaagaggtcagcacgcttcccctgcagggacgcggtgataccaacacacgctacgctggcagatttctcaagcggtttcaggtcacaatgaacatcgtagccttcgaacgacgtacggtccccacgagtagggtcagccttcaaatagcacagcaacggccatgtctcaatcatacgaatgattaagttagccacgtctgacgcctgcttctctgcaccggacacaatcaggatacggcaggattggtcctgtatgagcctccagacggcgtagagcgcagctagggtagacttagcctcaccgcgctgcgcggccaccatgcgcttcctggggcccttctgcatgtactctgcgatgtcagcctgcatgtccgtgagcgtaaagcccaggaaacgcatgccgatgtatgcgaattctcggaaatcgctgagggcagccgccatcatcatggcgatatcctcacgctcctctttgggaatactgcgagggttcgcgctataaccagtaagtttctggttgagcatgcgcaatcgtcgcacagtcttcaccgataccattagacaattccttctagtaagtcctcagagtctgaaccactaatcttgtttaaaatctctttcttacgcgcctctctgcgcgccgctagttcgtcatcaaattcgtcacgaaggtcctgcatctcctcggaatcggcgtccgcagtgatgtcattgtccttcaagaacttagcgataacggatttatctgcggcggggagcggcacctcatcttccttcgactgcttgatttcttcaatcaaggcctcagtgaacatgcggtgcagctccgagaggcgactgcgtttagccgcccctgccattatgcctccataatctactcaacagtaaatggccctatagttgccgcatcctctggggagatacccctctcgtaaaactccagccatgccatacggtatggcgcagccagtccctttggatgtaggatggcgcacacttctgcataccaatcatcgaaagaattgaagctactagacatacttttaacctctcaattgtgcccatatacgtctcggtgcgttatccacagcggttagcgtcacggttagagtggagccgtcagctgagattgtaggggttacagacaccccagtcgggctggcgcttgcaaggccccaacgtacccccgctaagcgtggagtgggttttgactgaggacgcatccaccgccacggtggctgtcgcaagttctctggagataatcaaatctgcatagaacctagacacggacccggtgtcggtgttgtttcgggcggttatctctaacttcctgactagtggttcactgtactgagcacgtgctccgtcagaacttactgtgaaggttagagttgcagtgctgcctgcacccgacagagcaagggaggacactttgtctcccaatctagtggcaccatcttcgctttggctaaatccaaagttcttaacgtccggaataccagcacaccccagcaccgataggttcttcacaaccccagaacgtaaccaggacgttccggtgaatccacccagcctagacccagtggctatgaaggtcttttcatccgaattcgccccagacgtcgacagcgtgtaagacggtgtagatgtaccgctaccatcatcattggcacccgctagggtgtctacgccgctgatgataatagaggaacgaccccccagctaactggaagtgggcatcatctacactgccaaccactgcgttcttcccggagcgctgaactgttacgccacaaactacccactgacctccgttcactgcaacaaaaccacttaagcctgcacggtcacacagttcaccacaaaccacattgcgcttagccccggaggcgaagtagttgtgcgcgccgttccactcgtttctaacgttcaggaagctgttgttattggccccagcattaagctcaacaccgttgtgtgtattggcgttaatggtacagtccgtgaacctggagtcaattacgttacgaacacccctgtagttactggcaagagcacacccaattacctgtacagttgcagtgtacccagaggaactggagccgccgataccgttaagccagcggtaaatcccacaagagtcgaatcggcaatactgagtttggtctgagccctacccccttcatcaagtttacagaagagttcctaccgtccagtattacgttgaggaatcggtgcctgcttgttaggatgaacggggctgtagccccagaagccagcctaatcaccgtgcccctagagttaaaggaagcattagaagacgctgtgtagggtttagccgccaccccggtaatagaaaacccagcaggaagcgtgaccggggtttgccccactacgtagataccaggtgcaggtgggaagtacagctcagttaccccggcagcaactgccgcggcaagggcgtaatccaccagcacctcagcacctatcgtactggttattatcgtcctatccccagcagacataaattcgaagatgctgcggcgcagtagaactgacacaggcgcgttcccactgctaattagggaggcaccggaaggggccgttagcagttccaagacggaggatacggcgctagtgtcggcatctgtgtcaataccgatagtcatatcaaccagggtaccggcagggagaacctcggcgaacttcactaccccggcggtaacagtgtacgaataaccggcagtctgcgtaaccccgttgacacgcaccttagccttagtgaagggcataccaggcgtcacggtatccgtatcggcagtcagaacggtccaccaagggaaactgttcgtgttagcgttgaaatatgtctgctcaaggttcgtagtgcgcacgtccaacgcatcatcagcagccttacgaatagacgcctcgttggctactgtggctacccaagcggcgtgctctgcgtcaatgcgttgttctagccgggcatccccggcatcaacgtactgcttgttcgcagcgtcgcgcgtatctactgggtctcccaggttggtgatgcggtaacggtgcatgttaatgtcgccgtagaatccctcgatagagcgcccctcaaccagctcttgggctaggtgtagaaactgcgtattctgggtatctacgttaccttcaatgaacggagcaccactagcaaactcaatgtagagatactctcgcgcagtcttacgaatgagtagcaccgctgtctctacagacagcggggagttcagacgaatattggtggagctggtccaagtgaaggcagtagtctcagcaccatctaagtaaacgtgaatataggacttatccaggtactcgatatcgcactggatatcctgagtacctgcaggctttaccgactcttgccagctgaatgccatattaatcgtctccgaagttattgatgatagctcgcgtaggtgcgaattcctggattagtggcacctgcttagtgaaggtcttgatatccatattaccggtagccaggtcctgtacggccccgagcagccctgtgacgtaacccatagatgctaatgagtgacgaggggaatcccccaggaagatatcctgcagtaaggataccccgccgatggcactcatacccattacggactcactgatgagtttctgggtgtctacgtccttcccgtccataccatgcttagccatagtagccagcagcattaacgggaactggtacgccatgatatgggctacgccaatccacccagcatcgttcagctctctacgcagaatcttgttagtggcggccagtgcgaagctctggtaccctacaatgactttgccgatagggttgaactgtgcaaagtgtgaggtctctccagtacgaatctgctgtaccaggtagtccatcatacgcgtacctacaacctcaacttgcatctgcaggtccggctggaacacagcgcccgggttagccttgttggcagcgatagctcggtccgcaacatcacgagtaagcccaaaacgctccagacgcttaaacgcctcagcatcgcccttgaacatctgagtaagctcgtctgccacgataccggagttcaggttaacctgtagccggtgcaccatactcatgccgttgacgtggcgcgcagcctgcccaacattctgagtgacgttgaaccaggaggcctgacgagtcaggtccaggttatcgtcagcgtacgtattcagccagcggaagcgcatctccttctggatattaccccgcagcacggtgtctagacgagcagccatatccggagtcttgatagctacggcaccttccttgaaccaaggctggtcacgcatactacgcagcactctagccataccgaactccttcatagccagggcagtatcagtcagctgatacaggccggagttcttaagcatggtggcgttagccatgttcccggctgctcgcagcaagtccggaagctgcccagcgtcagcaggtcgccccacccagaataaagtcgatggtgtcattaacggtcttctcccacttagcagaatctgccagtgcgtgcttggactcatcaatcatcttagcgagctgccccaggtcctgtacgcctgcataggccatgcccacacgtccagacatacggttagtgtacccgtgcataaccttggctacgtcagtatccatcaggtcctgcatgcgcatgctctttccgttaatcaggtactctttgtccatgttgaaccgagtacgctggcgcaagttccgcgcaggggacgtgctgccggattcgcgtacgttaccagccaggaagctctggattgcagactcttctacaccagcgctacgcatagccataacgacctcgtcgttacccataccgttaatcagctgcttccacataggaccagactgtccagcccggccattgtagacaccgtcaaccatctccttagcaacacgctgcactacctctgactccatgctcgggtacacgtcccgcagggcggaccggaacagggctcggtagtcgtccagagtgttaccctgtgcgataccttgacgcatcttgtcatagctgtactggcgcgggaagtagtagtcggatttaaccaacgcaccatcatctactagaccggcattgagcatatgctcgtgccacttgctagcccagccagagcgacggtaggcatcaaccagcggagcaatctctgcatccggtaccggaacagcgcgaccgtttacgtcagcgctgtaggcagcatccaggtacttactcaggcggtcttccagcgcagcccgctcagcgcggaaattactacgatggaagaagcgtgagagcacccctacacccttatccctcaacgcgcccaggatggcatcttccactacgctggcgcgagcatccatctccaaagtgaggttacgcttatagtctaccactgacgggcgacggccgcctactgcggacgcatccgacactagcagtttagccaagtcttcgttgccttgggcgatattatcgtacagggcaaacatagtggagagcttcttcttagcgccgtccagcatagcttgggcgcgcttagcctcattgagggtggtgctgtccgccaggtcctggaaggcttcgctacggaagctctgggcttggtctgcgtaatccttagcggtccacttaactgcgtcctcatacgcatccagtacatcctccaaggcagagcctttggccttgatgcccagggcattcatgatgtactcacccagttggcggagcatgctcttaccgggtgggggattgcgtccgcgccaagtgctcaacccattccgggctgtcacctaagcctgccagcatctcgtgcacactactggcgtagtaccgcatacgcggcgtcaaggttgagtcggcggcaataacagcacgcacttcctccaggcgtttagcaatctctggattactgtcaacggcgcgcgcagtagcggcatgaatcagttcgtgcacggccaccttgcttgtatctgcatccatagcgcgcagcgcatcaccgactgtagtccaggtgctgccgttagcttgcttaggcgcgcgcagagatatctctccccgcttagctaaatcttgttgtgtgtaagtgtagcggctgcggtttgcggagcctgctactagtttaaaatcaatgtcgtttacagcatcacctagcgtgtccagaatagccttctgacctgctgttaagtgttcagacttcttcaagaactgaactacatgctgtgctttcatgttcacggaggcagtattgtttctcgatacttggatgctttcatccagtgtcttagtgagaatttcctctccctctcctactccggtaacattagcatccctagctgtacgagttgtaggcgcttctgggtcgaacataggctcacgcccagtacgagccttggcggcagctttagcagccctagacatatcccagagctggtccaacccagcctacccccgctatcagtgcagttaccgcggcggactggcccagttggtcctgtgcatagaatgcagagcctacgtcagcagcacgaatagctgtacgtgcagctaagcccgcacggccagcaataccagcagcagacatcggagccaggatgaacggggaatcccctaccaacatacccgcgaacccggctactgtattgtcggccattaagcggtcacggtcacgttgctcaagcatctgctgcatgcggtagttgtaatcttctaccgacacggagtcgtgcaggtactcaatctcttcctgattcggagcatacagtttagcccgagtatcgctactcagggtctgcttggcattaaagttcgggtctcggtcaaacgccggagcagaggccttgcggatagctgcggcgatgatgctgttgcccatacccgacgcaaagctctccccggccgtagtagccggagtcttggcctgcgctagtaatgaggcacgctccagtgcgtttaagccgctgtctccggcatcgttccaatctacgcgtgcaggcgcagatttaagtgttgcgcccttagcagaatccttttcctgtggattcggttcttggttcagaaactgagccataatatctcctaaaagaattttgataaggggaggccccgaagggcctctggttagtgcgttgcttcgaagagccaatcacgtaggttttgttccaggtacttcttacgctcaggttgggcctgcctgtacgccggggtattccgcagcgcttgccaagccctaccctgggcctcagatacagggtactgataccgcccccaccggggacttagcagccttgcgtacctgtgccatagcctctgctacagggccagagctaccgttaccgccgtgatagttcaggtccaccatgacctttaacgcctcgtcggatgcattcaaaccctgccccttgagttgcttctgcacgttcgggacgtactgcttctccagggaggacttgaggatactgatgccgtcatcaatggtcactttctgtgggacaggcatgcctgagttaacgtgcaggccgaagcctacactacccttgccctcaccttctcggaacccttcgaacttcatagtggtggcgagaatgtcactaaacagtgatggttccagccctaccgagttacggccgttgacctgtacgctgacagcacgcccgttgtcatggtcgtagaaggtggcaggacgtacgcctacttgttcgctaccaatcttcatctcgccagccagcgctgagtcatacgcagcctgcgcagtagcctgaacgtctcgaaggtttacagacatcgtctggaaggagcccttcttgtcgaacacggttacggtcatgttctgacctgcgtttcccgcggtggcggcctgcacgactacacgctctatgttgctggggtctgacatatactgaacctggttctgtatatgctgctgcagggaggccttgaattgctcttggtcgcccttataatcgcccatgatagattgcacagaggtgcccgcgggcagatacacatgcctaggtgccccagcaatgtccagctccagcttacgggattggatattgccttttagcatcgtattgatgtcgtcagcgtccttccctacaagggattccggattgtggttatacacataacggtactcgtcttccatagcagctcgcgcttcctggcgctgggcgtctgcatccccgaagaagctgaaccagttagccgtgccgcttgggtccaccatcttgtccgtggggttactttggatattgctgtagcgcccactcgccttattcctagcctggcggcgaagatcgtccaagatagtgttgctggcattatttgggttttgtgtaacagctttctgcaccaccccacgccactcagatgggacctcagacagcagcgccatcttccctaagtccgtactggtgctataagcctgtgcccacaagttgatgctgttgacgttctcacgggaaacctcaccgtcctcaccgagctggtccagcgtagtcagcgtacgcgccatatccgaagacatacgcttgtgcgcttcgttgactgcccacgcgtccttgctgttgctcccgtacgccagcagctgcaggttcccttccggggtgtccggaaagctcttgagcagctgagtacgtgccttatctaagtctcctttgaacatacccgccaaagtggagcttggcatattcccagtaattgctgtgcgcaatgcctgggcgtctgctgccttctctcgaatggtctgggctttgttccagaactccatgctggtcccggcgctaagtacatcagatgccgacagctcaatgacacgactacgaatacgcgccattgtctgttcttgctgctcaggggtctgcccctccaagagactggattgcatctgagatttcaaaacgggcttgtgtctcaatctgagcaccagcgcgcttgaactcctgatatagcgctgcgttaacgtctacggagtttacaccaagttccttagtggcgagctcttgcagctggttgattaccagcgggtcctgagtctgctgcgctacgctaaccagatactgcttggcccggtccagcttcttgttcttatccaagtgctcagcagccaggatactgtctaagcccgtcttaatggacatctgcgcggcggcaccctgccctgcctgcagacgctgatagaactcatcgctggacgcactcagtccacggtcgagggcacggtcagcctgggccagggcgaatgcagcacgccctttctggaaggctgtatagttagccatactggtagcgcggagctgctgcagtatgctcgtagcagactgcttggacatatccgggagatacatcccgagcttgtctgacattgactgtacgtgctcttgctcctgctgctggaattcctcgtcagtaagccctgcctcggcagctttcttagcccgggcgatgctgtctgtgcgccacttggctagagtgtcgtacgcggcggcggatacgtagccgtcctggtaggcttcgcgcacgaagatgttttgcttctgtacagcctcgtccttagaagccattgcatctactgcgccctgagcatccatagcgccgcgcacggtggcggctgctgcgttttcttttactgcctcgtcaaaacctacgccgaagtcctgcacgaatccagacagggcggctaggcgttttgctttggaggtatcaacagatacttcacttaccgttgacggcaagctaacatcgttggattgcagttgcacgccaccgatatttagcccctgtctactgggttgaatcacaggcatttagtattcctcctaatttaccaggtgtgaactgggctattgcccttactcccccataagtcataggaggatgccatgctctgcgtagctgacgcgccgctcccaggcgaagagctgccagagtcagaagatgacgcagcgttaccggcgtactgcccaacagcggatgccccgacactcaacagtgagttaaacatgttatagtacgggtcctccatatccatgttagccaggccgctatccacggccttatctgtcattagacggaagccctcttcctgggttgcctgctggtcacgtacgctggcctcttgccgcccggctacagtgttcaccgtggctacggcgtctttaacagaggcccccatagtgccggaagctgctgcctgcagtcctacttggctctgtgcctgcagcttctgctgctgaatgttaaacagagacacctcagtccggtccctggactgggcgcgctgtagcgcgatgtcgtttagctgtttggctgtctgttgaatcacagccttgttcctggccttggacacttcaatctgagcaccctgccccagaacggtcttagcggccatggccgcaaccatccaccacatattaaattctccgtctgcgttggttgtagcgcaggatatatgaaatatcaagcacgttcagttccatagagccctcagtaaatagcgacacctcggttgtgtctgcgttagtacggcacggcacggtaatcgtagccaagtccatacgcagagcctgcccaagcgtcagctcctttgagttcatcaggataccagttagctccccaccccagttgacatcccgtggggtgtcgagtacctgcacatcgaagtgcccagagttacgtaccgccacgtccaggcgcagcaggcgcacatgcccacttcctacgagtttgtcattctggtcccgtagaataggcgtagttagcgtgaaagtactacggtaacgtctcccgattacataagtgccatcaggtacgccgcgcacaacccgtagggtgttctccccggcaatctccttgatgccgacctcagtaggccccatagggttgctgggtaagtacgttaggataagctcttccttgtagttgtccgcccacccaaccgggcgcaataccgccggaacagtgaacacccctccctgtacttgaacttgcttctgcaaatccgagtaggcttcgcggtactctgaacccaactgataaccttcacgcgggtccatagacacaatcaggagcttgttgctgggactgggcccttgcatgtacaagaacacttcgtcctccagcgcctgtacgctcaggattgggtacgggaacgaccacttatgccacgctgcctgcatcttagcgccgccacttccgccccacatgaactcgtagaccagcaggctattacgctctccagacatgcgcgagaaggccatattggtgacactggagttttgcatctgcaataccctgcctgggatataccgaggtaggtgcactgtggcatcctgcgtagtgtactgcgcagcggtgtacggcgacgggattagctccaatatacccgcgtagctgtcgttgcgtttgttcgggtagattactgtctgacccgccattaccggggtaacacggctgtcacaatcgtaggtgctggtaatgctaatgcttgcgttggtaggcgtaagcactgcagagcccggcacaaccgcctgcatgctattagcaaacagaaccaagtcccggttgaactgcacagcggtgcggtacacagaatcctgggcagacgcagagctaatgctgatacggtccgtatccagcaaggacgtcacagtagagcggtagaagcgctgatacaggcccgaggctgacatatccacggagctaccactaagcaggaccaggcgcccctggaaagctgcaataccagtgatgtagccattctcgacgaatccgggattactgttgttatcgtcgttaccagctaagcgcccctcccaatcgcgcgcaatgatgttgtcatccgcggcgagctctctgggcatattcgtaatcttggtgatgctaccgtacgcccccacctcagaccaggtgcgggtactgtagctgaactggtaccatgctgtctcagacgaggcagtacctacacggcacattgctccgtcagcttgcgctgggagctgtgcaggcaggtcctgctcctggtctacacgagactggttggacaccccagcgtaagtatcacccgcgtcagaggataccacgcagttgctcaacccgtagaagaacaagtacgcgccacgtacgctcacgttcccagctggcaacccatccgctacaagagagtcacgcagttgctgagcaacgtaagcaccagatacctcctcagcattgccgctggtgctaccggcagccggtgcggtgtagtccccagtgtagtccaccccagcagaggtgacggtgacgttccagcgtttctggaatgctgcggatttaacgtagaagaacccggtggtgctggggtcgatgcgcccagtattgtccacggttgtgttcggagccatctcagtattcaggatataagtcaatccagcaatacttgcggtctgcaaagaggtctggcctacggtggtaacaaagtacgggtcattgccggaattaagtatggtctttccattcttagccagcaaccaccagttaccgttgctggtgttaatcagcaggtgcctaccgtcagtgccacgctcgacatattcggtgaacagggagtcaagccccggattatcaatcgtactctcccagacaatctcgcctggaggtctacggcggatacccgaaaccgggtcgcttagcatgttcagctgccgcccccagttgtcctggttggcgctctctcggaacctgctgggaaacaccctgcagcaagctctgaatagtaccttctaatgattgcgccataacctctccttaaaccataaaacgagcgcggcggattctgcgtgcaaagcgggtcttgctggtgctgaacttctgattgcgcagatgctcgcgcagcaccatgctcttgtaccgctcagcttcctgtgcgtaattagcgtagttgctgtcgccgcccaggtcgtttaagtatacctgtgcagtggtgtagttagccacccacatagcggcgtgctccggtaggtcctcaaaggctaaatccaggaccacgcgaatacgtacaggcgtatcgaagtattggttctgctctaccaggtcgtacaggtttccatcacgtaccccgtacttggagtctgagcaggcatcgtacacggccagctggttccacggcaccttaatcaggccgtcagtggtgggggtaacgttcgcgctcgaccacgttaaaccagaaccccgtgctgagtaacccgcgacgattgcgtgcaagcgcagagcgagcctaaccccgcactcgggttactagtgttgatgtccataacgcgagactccccgagggcttccaacgtcaggttcacagcgtctaattctctcatatttgttcctctactaaacgaccccttggacccttaagacagggaaacaaaaaaaaacgcccctggcacccgaaggcaccaggggcgcgtattactcttccgtagtatcagcggctacgtcagccgccttacgggttttcttggtagccttgcggccagattcaaccgaagccacctggatgttcttcgctacatcggtggcggccttaaccgcctcccgctgagctgcattggcctggagagtctccagaccgaacgtagcgattactgccattgaacctccaattaggccgtcttggtggtgaaggtgaacttagtcactgcagcggtgtccggacgacgcaggccgatgttgtacatcgcgtagcagtccagcacgttgctgaactcgcgctcatcatcccagatacgggaggtgaacggcttagcttcaacagtcaccagggtcttggacttgctgaaagtcaccatacggcacagcgcgtcgtcagaggtgacggtgtaagcagagccaagcgggtgcgtaccagcagcggtcgggaactcggtgcactctactacaggcactccgttcatcttcactacacggcggtctttgtaaccgtcgttgttggatgcgccaaagtccaggttcaggagcttcggatgctccagcagacgcgaataggtatcgacatccaccagggtaatcatgtccgccagcggagtcttgcgcttgatgagttcatcaataccagccttgtgggccaggttgatgttcatggcgttcgcctccatctcagcctgggtcagctgcgtggcggtagtggtgtcaggaaccaggatagctgcatccacctcaataccgtcgttgaacgccggtttcaggtgcgccggagcaacccaggaacggcccttgattagctgaatcaggtgcgcctggtcgaaggtctctgcgaactcggagccgttgttctggcccatctcggtcaggaagtccggaccggtccagtcatcctggtagtcaatcgggttacggatgtacagcaccgtatccaccacgataatcatcttatcgttacggaccggagtgctgtccagcgcctcaccggagcgacgacctttcaccgatgaggtgttcaggcggtcaatacggtaggtgttggaaccgctgatagagcgctggctggagaggcccaggaacagagcctggtactggaagcgggtatccacttcgttctggtacacttccaggtgaatatctacgtcagacgccgcgccgccccagtgcggacgagtcaggttgccattataaatagtgttggccatgcttttagtttcctttaataaaataaaattaaagacctacgcgcttaccagcttcacggcgtgcgagcaaatcgttataacgttgactgaactgtggagacgccaagctacggttgcccgcttcctgacggagtttggtatattctgcgcggaattccgcagcagatagtgcattgttgctggctacaccacgtaccattgggttctgtgtcttgataagacccatatcccggcagaagcttgctaccaactcagcggcctgcttgagctcaccagagttagctagtacacgagccgcgttacgcagaggttcaggggccttggaattaaacagctgcgctgctacctcccagctctccttaccgcccacgatatcgtaagcttcctgcactgctttggtggcttgaccaacctggtcttccaggtacgctttagccagcaactctgcataagcagcgtgctctccgaaacgttccttaatgaaggccgtatcgattaggttagggtcctgatactccagggccttgccaagtgcccgcaccatatcagagtcagttaacccagagactttctgcaacatagctacaccggcgtcaatcgtcggattgcctgtcttagccagctcctggggctgctctttagcgctatcgccacccttatccagggccgcttttagggcttcgatatccagaggaatcttagcagggtcaggggaatctttgccctgttgctgctgggtagtggtctgtgcatcctgcacgccttgattggttcggggcgctaagaggagcacctaggcccggaatcttagggccgccttggttctctacctgtgtagtttctacgttctgaccgttttctacgttatccatctatgcctctgttgttaacttggtaataagcccagctgcttacctgctactgtcgggtctgctgctgtcaagccctggagttggtcctgcgcggcacctgcggatacatcggcagacgcatcttgaacctgttgcttctgctgcagctgctcttcggtgtacatgaacggctcgctgacgataccataggcgtcgaagtaccaatctacgcacgcatccttgttgaagcgtggagtaatctgctcaagcaccgggatagccagctgcatggactgtgccgcctctaacagcttgtccgctgctgcggctttagctagtgcagaggtgccaacagtaacgttgatgctaaccacgccttcgctgaggtacagcttaaagcgaggatacgccagcgcagtgtacaggtacgccagcttacgcagccaggtgtcgctcaggatactgaacccaccgcccatagcggcttccgcctctttggcattctggcgaatctcgtaagccgtgacgcgctcgccctgccgggagttgccggtgtacataaacgcacgagacagtttctgttcgagcatctgaatgttgctggcaatccactgaatcttctgagcagagccgccctcataagcagtgacgggggagtttgctgttcccgttggaaccgccgccgcccacctgcacagcctcgcccgtctccgacgttgcgaactcatctacatccagaccggaacttgcgtcaatcagcgggattaaccgcgccgactcaacctcgtagttagttaacgcttccgacagtacagataatctagcaaagtccccagcgtagtcctctactaagccgcgtccgtagtgctcgccgctaacaaggttccacaccagcacgttgtatggaagctccagctccggataggtgctgctgtctccgatgcggtgcccgtctgcttcttggtacacctcgtagcttactacctctgcaccgtcctctgtccgcttaaccttgcgacaagcggcagtgtagatatcaacgtcgccgtatgggtctttgtcacggtagaaggtgccgcggaaactctctggcaggtcctggacgcttgcgcgctctctgataatgagtcgcaggacgttaccgctgccatcccttcgaacggtaaagttacggactgagtagacgatggatttacctgtccgctcatcaatatactccaacgcgttacctgtaaccagcagcagcttcacagcttgcaacttcgcagcataaccgtctttctcaaatactttctgtgacgctgtgttctcgacctcggccagcttagattctgctgtagcagcgctgcccagcgaaccaatgaactcgtccaggtccgaactcttggagaaccggaagaaactagtgccttgtgggaacagtgcgcctacaatcttagtggctgcagtgttgaccagctgcgcaccggtgctctgatagtctcgctccagcggcctgcgtctaccgtccagggaatcgtccctggtaaagatagtgctgagcgtccactgcgcgaacttctcagaggcatccaagacgcctgcgtcctggtccttcttaaagagttctgctaatgttgtctttttgttccaagcctacccccttaccaggcccagaggattgctctgccctgcttgtcgccgtttcttctgctcagacgtaattgcgtctgcagatgcagaggcagcccctgcggggtcaatctccgcaatgttatctgcggcgctattagcctctaaggcagcctgctgtttcgctgcgctggcctgctgctctgccaagcgctgctgcgcctctaatcctgcgttgtcagtaaggccgagcatatccgtggccttgcctaacagtttacctaatccaccgctcattctgacctcactaaatgataagttgttttgtacgtgttaccagacgtgctccggctaatggcgatacgcccagcgcgcatgcacttggctattgcgtgcaggccctgcataatcacaagtaccgccttactgttacccggcttcaatacgaagaagtctgtatacagcacaggctctacgtaatgacagtcctctacagcttctgagtagtagctgacagcaccgactaagtcgccttgggagtcatagactcctagtatatactgtttacccagtatgctgcccagtactctccagtagtgctgctctggagctaggccccgactaatgccgtggcccagttcgtgcagttgcctcactgcgtctgtaatgtcgtcagacttatacagaaccttgagagtgtaatcggaagttttactagtgtgttttaacttcattcctactccggtaacttcatttatcagcagaagaagaaaggtgattccagcacttgccggatgtccagggtacccacctcaggcatatccaaatccgtcaagtccgcccctgctgctgctgccgcgcgagtaatatctcccagcaggtcatgctcttcgtataggcgtacaaactgttcgcggatgtgtcggtgcagagcgtcaacatcggctgcatgtgtagccagggagtcgtgaatcggcacaatatccagaccgtcagctgcacatagaaccatcatcaagtgcgtactatccaggctatgcacaaagttcggggcaatcccggaggctgccttgcgcttgttgcaggtcttgaaatcccggttatgcacgcgcatgatggtgaggttcatgcagtcaatgcgtacccgcacctcttcacgctgcgtgtagcggttcattacaagcccgcccagcggcgtataccactgcaggtgctggcttgccggtacacgtctagcgagattctgcaagtacgacataactgccgcagcagcggggtttgcctcctcgatagcggcgcgcatacgtggtgccaggtagcacgacaggttccacagactgttagtatcggtaccctcgtatccctcagcgcaagcgccttcaaagatgtagtcgctgcagctacgcaccgtggcgctgtagaagtatgtcatacttgggcgcttggtcatgctgcgggtgatttcgttctctctccagtatgtgctctggataacgaaatcctccttgtccaggtccagtattaccttctcatccgtacggcgcttcacgtccatgtacaggtccgctttcttgtcgttaccctcccagtacaggttcgtcagacgaccgcccacagggtctctcaggagcgctgagaggtgctgcccacctgagttcgtagcgtccatagccactggtattcggctaatatactcttctgggcatccagaacgaacagcattaaccaagtcgatagcggctgccaggaagcaccaggggctgtctgccttggcaaaagcagggcaatcaaacggagatattgtgagttgctcaatttctgcaaagttcgcatcaacccaagctgcgcggtcttcgaataaggtcttgtcataaccaaagcatgtggcgacgtgcactttgagccagaaaagtccgcgctctcccaaaggtttaccacgtccaaattcaagaagggctttctgcaaatcagaaccttgggggtgcagcgaggacttgaagtacaggcggtagcgccagtccacacaagtcgggaagtacagggctttctcatctttgaattcctctgccatttccaacgtagtcagaaggctgcgcagttgcgatacacgcttacggtcggcgctgtaccatagagacatacgcgtcttccactcaccgaagcggtcaagctcttcctcggtgtaattctctttcggaaccccgtccagataccactccggtttcggctccggtactgagcggggcataccctaccccaacacccagggcccgtgcttcttgcaccagttccagtatgcgcttattaatacggtacggggtttcctgtgccttattaagcgtcttttttgatgccgtccgcggatttaaatgcctccgctacttcacggagacgagctctgtcaatgtgcgagttatggtaggtgccgcgattgtcgagtaggggtgaggtacccaccatcccacagagtagtgtgctgcaccggcggtaccagcataggtggcttcatggttacggtatcagcggactctaccagtttctggaaggcctccataacgtcgtcagccggatagagcatgctcagattcccgctacagttcttccactggaacagtcccgtctcaaacactgcggcacacagcagacgccctacggagatgttctgggcattggtccaaggctcgtgcccgtagtgtacgttctcggcactggcacggagcgtacgcaggatgtgcgtaggggacttcgtacggcgctctgtgaggtactcatacacgcggtccatgtacgctggggctacgttgcgtaactgcagagccagtagctctgactgtacgtttctgcccagtgcggacattaccgcctgtgcagtctgacggcgactggcggactcgccaggggcgacgctgaacgcctcaaacatcgtgcacaggctaagggttgtcaggacatccgaaggggattaagcgcaggaaccggcggtacttcccaccaatgccaggggctttgacatttcgcatctcatcgatagcggcagcagccacttcatatgccgaggtgagcatacgctgcgtcatcggcaggttcataatcccgccgttctgcaatgcgtccgtaatcagcttacgcgctcgctcgattccgcgaatcttataggtctcttcaagctccagctggcgtttcaccagcgcttcctctggtactacaaccgtatttagggcgctaatcataggcgcttagtctccttggttatgtccggtacttctaactactgattgcgacttacccagagattatacatctccaggttagtttttagcgtcgcgttcgtcgcctcgctctactgctttctgccacatcatgtggcaccactcacttggccgcactatccatctgctccagttctagaataaataacgcacagcaagcggcgtgcgccaggtgcggtaaaccgctctccgagtccagcgtttctcccagagcgtgtgctgtgaggtgccgcagtagcgcggccttgtatcgggacttaccttcggctaccgtgtgccaactgtgtgccgcatacttctgggccccgaaggtcagcacatcactgatacgcagcaacgcattcgggcacccgtccagtagcaagtccattcgaggtttgcctgcgtcatacttcatgcctgtacctactgcactcatgctaattcctccaccccgtgggtattttaagtctgttcgatgtgctgctgcaccatagtcgcatacagcgtaagtggtaatacctagtccgcggaaatgctcaatcactgcggggctgtcatcccaagccgccacaatgttttcctagccctacttggttgcgcaggaactcctctttgataattatatcctttcggttgtcgctgtgcggcctcataaccagctcggagtacataacgaagttccgctccagccaggcctctgtttccgctcttactatatccgagcgccccgtccaagataataacccgcaaccctgcccgcaccatgatgttgcacacttcaatagtgctatggatagggctgtcatccttcgaggcccggttgaattcgttccagctgtcagtcagatgcaaatccacagtaggcagcaagtgcaagcggtgtgtaccatcagccagcgtgccgtccaaatcaaagattactgccttcacttaatagtctcccgtgctttgcgtcgtgcccgggccttgcgggccttgagcttctgtgcctgtgccaattcttccggcgtcttgtgcgtatagtatagcatatccgtaggttcgcggtctaagtaatcggcgaccctacgtagagattcagcaatagccccagaagattgcatgctaccaacaatccagcgcccagcggcagatgccactttgccttcccctccattgcacgagcgatgaagagcaccccgaatacgcccagtaatatgatcgtggtcaacgacaacagaatcaccagttacccccttgattgtgaagtccaaaggtttgccgcaaaggaggcagatacctccctggtctttggcaagcttaatcgccacggagcgaatctgtgcccgtgtaatctttcttagggccatagctcaatctccccaactaaatccagcatagcattgtcgtgaatgagagaatccaaatgctcaaccgttcttcgatgtgttttgggtgctcgttcacgcagcgcatccagaatagtttcaagttcatcgtgtttcccctcgtagtataactcaatcgcccgcaggctcatttccttcgcagacatcttcgccattgtctgggtgctcctgtatccactgtatatgctgtttatggtactcgtgcagcgaatgcacccagtcacgtagactgggagtagtcaacagtgacatcagatactgataggcagaatctgattgggagcgtctcagccacaggcattctgcctctgcgagtacgtcttggttgtttcgagcataggccgctacaacgaattctgcggcgtcctgctctgaggtaatagggtagatagcatcaaaggccgttcgcttcccacagagcttcccatcaagcaatgtgatgcctttgacgttatctgcgtcatctcctgctagcatttgccaccagaagaacttagtgccgtgcgctcgtaccggcatagcctgggtatcgtcccacttaatccagccgaatgggttatccaaggcaggccacacggttccggtagggatatcgaaccgagccatagggctgagccaagaatccttgtcctgcgacatcaggattccccggtccccgaagctgtacgaatccattacaaagaggtcgtcggcctcaaagtagtcgctgcttaccacctgtatgccatgctcagaatactggtccgggttctcaatcaggtgccgcttcaacggtgcctttagtggcagctcctgacgcttattgcggttcccttggtacggcttagccgtaggcaggtgccagcgcaggcacttagcacaccctgtaggcgtcagatacgccactgcttctgagcagccgaccaggaacatgtcctcaagcagtagctgatagaagcggcggattgcagtgtccaaacgtttcactgtagcggcagatttataaactgtgaaatccgcgtcatacagcagaatcttcccagagttctgtggagctaactgctccccgagctgggacaagtcaaccccgttgataatcattagtgccccgtaatatcacgggccttcttgtcggcccagctaacccaatgctctgcccactttgccctgctcagcttatcaccgatataacatagtcccgccaacggaatcagtgggagaatcaaagctacgtaaattgcgcgagatacgtacagcatcattaaatctccagtctagctactgatttagctgccaacttcacctgcttgcgggtaggtttagcggcccagcgcaccacatacatggtgccagggtcgtcctcccggataaaggttacgtaccagcggttgcaggcatgttcagcataaggtgccataaagctgtgtctaggtgcagacacctttacacgtacgctcatgcttaaatctccaaattggcggtaaaagcacggattgcacgggttagcacagatacaccctttgcgccgcctaccacactaagcgccaatgccattaacgtcaagccaactgcgagtagcgccagcgcaggaactaagattatgtaggatataagtttacgcatcatttaccctccagttcagaaagcaccagcacggtgccgagcatgtccccgattacttccggagtacgcagactctggtctgcatcgtaaatacaggaaccgatctcagccagcccgatgctgagggtacctacaacgcggataagcacgaggtcatcaccacgtaacttatcggcgtgtgccaccaggtcattgtgctctttgaaggcagtggcggccagctccaggtccatgccatacagggcggccagcttgtccagggcgtcgtaaacatcacaaaggcggtatacgcgaaccccacacaccgaggcatcgtgaattgcggcgctgaccgcaatggccagattcttgtacgcgttcagtacttggtccattagtcaaatcctttcagtttgtgttttgaaatgaaattgtgggctttggtctcagtggccgtagcctctgcgcccagggcgtatgcacggcgccgggacttggcgcactggcgagtcaggtggtagcggtgtgcactaatctcattacccagaaggctcaccctgtgtgcgtgagagttagccgcccagtaccagtcatttgctcgcttctgcaaacgctgtgcacgcagaagcagaaacacggcgtactgttctttgacccatgtgattacgcgcatttatgcccccgggaacgctcgccacttcatcgcgcttagcgcgcagtttgtctgcctgctcggcatgcttcaccgcttcatctttgctgtgcttggaggcttctacgcgcgcctcggattgagcggccagacgcacggcgtcgtctgcgaacttaactgacagctgctcgttaaactgcgctttggcatcggcgcgtttagcttctgctgtgtaggctgcactcaggagtttgataaggatgttgatgatgttcataggcttcctctaaggccccaggcggggccgtattagtttaggttagggtagattaggcttgaggtgcagcaggcgctgctggtgctacaggagccgcgggtgccactggagcagctggtgccactggagcagctggtgccactggagcagctggtgctgccggagcagtcggtgcctgcatagctgtcggactcggaaccgaaccagcgttcagcataatgtccagggcactgcccgggaagtctacagctttatacatgtcctcctgaatccagttcttgcttttgccgtcgtcgaaggtgccttcgatgtgcaggctatcccaggtctctttggttgggttgttccacaggaacagcttaatctcggaggcgtccagggcaggcatcttgataggctcgccggtgtttgggtcgaacttcggaatcgggcggataccggacagatccacgatgttagacttcttgcccgcggcactggtgtgctcatcaatcgggaaggtgaacgcctggcccagacgctgcgcagcatgcttaatgctgttatcgtagttcagcttatcgaagaacttcttgaagcctgctcgctcaaagttactgatagccatcgggtacgggcggatacgcttcacttcgccgttagggccgaacactacaatgccgatgcgtacgttagccactgcaggcttaccggtaggcttaccgcccttagtcggcagacgcttaccaatttccacgtactcggtgaagtagccgtagtactcacccttcggcagcagcacgtcctcatacgcgccgccctgtgatgtctcggtcatatcaacatcttgcgtttcaatcgcagcagctaccagggagttcagagtgtccagtgcgttcatagtcatataattacgtcctcgtttagtttaaatgatatttacgtgcagatgcaggcccggcctagcggttcttaaatgcggacttaatgccgatagctgcagctgccgcccaccccgcccgctgccagtattgccaacagcaaggcgataccgccatagaacggaagtagtacccaccaccaagaccaagcgataacgccagtgagtttcagggttacaaagataaggcccagtacagaacagattcccattttcattggtgctcctaattaggtttggattgtgtcgcctaacttttaaactcagagctgaggcttcatctttataccaccgctccgtctcagacttgtcgcccccagcagtcatactctagggttacacggtacacctggtattgctcatcccatacgggtgcatctactcgggtgacggttgaatctagcacattcatttgcttatccctacccaacgaccatcgtcatcgagcagcattggaatcagctgtggacaaccctcggtgattaccatcacacccaggattggtttcttgcgggtgagcctgccgtaggcaaaggccatgctcttgcggtcaatcagacacccggcgtaggccccaaagtacagcgccgtgctgctagccgcatactgaacctcgaagcgtccatgctcatgccccaacaccagagaggtgcgctcatgggatgcattgagcatgaaatcaccgctgacttgatgctggaaacggacaggccccacgcggtgtattgagcacccaagcgtcggcccacgaccacgccggagcaccatgctcagggaataggatatcccggtacttcttgataaattgcactggcaaaccgtgagctttagcgcggcgatatacgagtgagccgtgattggaatcgcaaaccagtaggttcgggaatagttcatgcagctcctccagtactagcttggctttctccagctcccaccccggcgctatccaggttagggtcagagtcgtggaagctgattgcgtgcccatcggtctcgtcacctacctgcaccaccatgtccgggcagtaggcgtcacgcacactttcaaggaatgtcatagcgtctacgtgggtatacggagcgtgcaacgtccccaaccaccagaatgcggtgacacatatccggcaccaccgtattcccgatatcatcagtagggctcggttggattagcttgcgcgcttcctgcagcccacgattggcgcgcgccttgcttccgttgttatccatgaatatgctgcgccagtagcgcacaagctggcgggacaccttcaactccatagcatccagtgtgttgtagaactcggacatgtccgggcccgtaggggcttctccgccatatgccaacaggacattatatgccctagccgccgtggcattatccagatatttacccaggattgcccgatgctgctctttggtgaatagttttattagactgactttagccaaggttgcctctcttgtgttgttcctactcgtatcacattaattctcggggaatcacagaatcaagccaaagtcaacaaataattttatttaattatttagttgaccctagtgtatttccatgctaccctaaccccctacaccacccaagggtccacctatcactactccgcgatgagctcgtactctccagcgaagaaggtgatgccgtccccaggcttctctgagttgctgtccggattgagtagctccacctcgccgaatccaacgtcgtaagatatc

SEQ ID NO: 11 - RNA, 73 nt, Pseudomonas bacteriophage F99/10
cccucguuggccgagaggaucaggcagcagauugcaaaucugccauacaucgguucaaauccgauacgaggcu

SEQ ID NO: 12 - RNA, 75 nt, Pseudomonas bacteriophage F99/10
cuccucguagcucagucugguuagagugucggauuuggaauccgaaggucgaagguucaaauccuuccgggguga

SEQ ID NO: 13 - RNA, 74 nt, Pseudomonas bacteriophage F99/10
gcggguuucguauagucugguuauuauucuuggcuuccacccaagagacuaggguucgaaucccuaagcccgca

SEQ ID NO: 14 - RNA, 73 nt, Pseudomonas bacteriophage F99/10
gcgcuugaagcuaacuagguagaagcaccggguugaaauuccggaggacuuggaucguuaccaagcgggcgca

SEQ ID NO: 15 - RNA, 73 nt, Pseudomonas bacteriophage F99/10
gcaguuauagauuaauugguuaaaucgccagacuuucaaucugguguuccggguucgauccccgguaacugcu

SEQ ID NO: 16 - protein, 506 aa, Pseudomonas bacteriophage F99/10
METTKVPDKKLGPIALALKEARENFDLSPHVIGPKSFKQKEFTDSDAKITVFGGAAGAGKSYLGVMDFMKYIHDPNFRGVMTRRTTPQIKGPGGLLEKATDLFKLVDPKVKWKDKDGKFVFSSGAVIFLRHFEQESDKDSFQGWEVSKFLVDEGQQFTEGMVTYLISRMRNPKCSVVPHMKITCNPDYNSFLRKWIEWWLDPDTGIPIPERSGVTRWFVRKGGKMFWGDTKEECIALHGNPSLAPDDEDQVKPISFKFIAANCFDNPILMLNDPEYVANLEALPRVEREKLLDGSWHAREEGAGYFTRDWCQIVPHPPLRVLKRVRAWDISGSIESETNRNPDWTAGVLMSRTKEGLFTVEDVVRERRLFGGVFDLILETAKQDGQDVEIQIPCDPGAAGKAYAAQLIRDLADHGFHARPKTTNKSKVTRFAPFVSVAETKSVQVVAGDWNEDYFDELERFDGSKAIKDDQVDATSDAFNALSLGSLIIPDFLPPDMTQSNKFKLN

SEQ ID NO: 17 - protein, 479 aa, Pseudomonas bacteriophage F99/10
MAETEKTAPGIPRLRLGEIGSTGLKQVNGTILEERRPELRFPRACRTFQMMAEDPTIKSALDLFEMMMSRVDWEVDLGVDPDEAMKARGKFLKECMHDMEHSWYSFIKEVTSFYTYGFSVHEMVFKRREGYPVSKYNDNKFGIKKLPIRSQSTITKWLYSEDGRNFLGCEQSLANVVNGDRYVNLGNKDGTVEIPAKKMLLFRVDAKRDSPEGNSPLRACYNAWRYRVEIEEQESVGVTRDMNGMPTLYLPPRYMSEDATEAERAVYEYYKRVIRNIQMNEQSGLILPQAFDPESRQPLFKFELTSSQGSKMYDTDAIIRRWDNKILQALFADMLKMGQDQVGSYSLAGAKTNIMAMAIESRLREIKDVLDNKLIPTLFALNGDYSPDLPKLQYGELDEIDLEEFSKGIQRIGSVGGLERDREVYNKIRKALKIKPRPDDEPVDVDNIMGGQSQAGKAGVGNGASTSAAGRDNAAANNA

SEQ ID NO: 18 - protein, 156 aa, Pseudomonas bacteriophage F99/10
MLTLESVIEALSNAFGAPAKAEEAPAVEVTKSLDNEKRMALFVVLEPQEGDSTTDLHADTYSEEEVEKACINFNTHCNVANIFHKIETQEAEIVQSFIAPSAFTTDDGREIKKGTWLQWWHFPEGSEVADALWEGVKSGEFTGVSIGARATVEDIE

SEQ ID NO: 19 - protein, 305 aa, Pseudomonas bacteriophage F99/10
MTVKAKRKLTDIKFEHEGAHVALVSKLQGGAANGHTTLITKATNGVTEELIDKAAEVTVTMQFPEFLRKFFGMYYEDAEVLSVAMGYGRTEYPELDHKDWIDQRVESMSILKSVYKSADLNQALSELTPEQTLSLKQDQELLEKALEVVSEQSNENPSKEITNMETILKSAHLEALADAIAVEKAAGVAAVAEVQKQLDAANVELTALREIVKAAEAEKTAAIAKARKEQLAEVLPADQVEDTFKSLEVLDDQAFAQTVGTLRILKAAADQNDMLVEKGVSGAGEEDDSVVAGVAAILKARHGSK

SEQ ID NO: 20 - protein, 136 aa, Pseudomonas bacteriophage F99/10
MAQNIIAKDHQRLSNWLKEEQMGHRGLFYTRETLPVADIDVKTTGSVLDSTGKLVTKATIADATYILITDLHDYANAQMSHAVVLARGFAKIGSKAVIFGADVDDADKATVFEAFKAKNIFAVDQIEGAFENVTFA

SEQ ID NO: 21 - protein, 344 aa, Pseudomonas bacteriophage F99/10
MANTRSYLNDGQFYIADQTENLLIIPNTWTLVENMGVFTSEGVTQNTVQFEEIETRYGLVKDAIRGTRHQVASDQRRQLRAFAIPHFNQDDYITPEDIQGKRAFGADREETLNEVRARKLETIRRNWANTAEVASVSAIVTGKSYAPAGTIEYDWYDLMGKTRKVVGFDLTNPTADVMGKTEEIFVHMQDNSQDGLIRGDFVALCSPEFFTALINHPSIKEFYKAYQASPQYWRERLTARGLDLRFREFYFGNIHFIEYRGVDPYGNRLIPAGDAYFIPTDSGDLFARYFGPGSTFDDLGTLGKELYATERMAEDRRSILIETESNFIHVLRRPQMIVRGTVNA

SEQ ID NO: 22 - protein, 158 aa, Pseudomonas bacteriophage F99/10
MAYTGDPANNPIDRLREIVGDVWEPPMLSDETYQWVLDKNEGNERRAALELMRMMLFRLTRGMRERTGDIEVYGAEYFNNYLKALQLILKDPNIAISLAVPYAGGISKSDMLANDLDPDNVTREFYIGFARREKLYNQCNPGPQDLSMGCDYLGKLQF

SEQ ID NO: 23 - protein, 141 aa, Pseudomonas bacteriophage F99/10
LIKRVEALDGTTVEVGFFPEDRYGSENGNLPVAQVAAYNEFGTTRNPTRPFMAPTFEEFTSQFHYARLMKSTFENVLRDGRQTNTLLKKLGKMVAEQMQVNIDDYPGSNSPAWAAYKGFNDPLFHTGKMLESVKFQIHRRQ

SEQ ID NO: 24 - protein, 126 aa, Pseudomonas bacteriophage F99/10
MLYPTFSMTNFVKLDLIRRGQPGDDGFGRPTPPVETVVTITANVQPIEKSTDTRILPEADRSKACFKVYSRGEEIRQLKEGPGGWSADRFMWEGELYEVMKVINYSMGILNHYKAICMRVERNSTA

SEQ ID NO: 25 - protein, 187 aa, Pseudomonas bacteriophage F99/10
MIHTELENSLYLMVKELFPDWRVIQAYTNNQEPQTPYLAIDIKRLDELGRENVSNMSDPISPSHGTIQVQQDFAAKVVFELIGKYGETASVSDMAMAITRAMRTPAGHAAQRKFNLSLFKLPSTRRVPMLRETDMYMFYQVTCEFGFSVIETTTQEFAAGADIHGVYYDAGRPGHIIESHIDINFEH

SEQ ID NO: 26 - protein, 428 aa, Pseudomonas bacteriophage F99/10
MTVLTDVIDIQISRETAAVAQTNFNVPLFIASHTNFSERARVYNSLKGVAEDFGESDPTYLAAVRYFGQALKPRSLVIGRRQVPSATVSVSVVQEGQSYVLTVNGLPVSYVSQQDDTATLIATGLKAAYDVTPVAGVTVTDNEDGTLTVASNEDWSLKVSSNLTMAAAPSTEGWPAAITAVQGENDEWYALSIDSHADDDIMAVATHIEGTKKVFVGATAQANTKTSADNDIASRLVAGGFQRTALMYHPNADAQFPECAWVGYQLQEQPGSNTWTHKALAAVDAYRLTPTESTNLKNKNVTTFERVGGVNRTFGGAMAGGEWIDVMIFVDWLEARMTERLWFRMANSKKIPYDAVGATILESEIRAQLNEGIRVGGLAEAPAPKVFVPDVLSMSPNMRAQRIFEGIEFEARLAGAIHFVHIRGTVTV

SEQ ID NO: 27 - protein, 174 aa, Pseudomonas bacteriophage F99/10
MAVQRLATFSPADVTIVITHPATGESMVLGGFSEDSIVNIERNADTYVMYTGADNTSTRVYNASKSATLTVSLQQTSPSNDFLTALYNYDDARRSSEGLFTIHVKDNSGRSDYFSDDAYVGVVPGSNFSNSMQTRDWVIHAHNLQTLIGGNAKLSPGDADTLRNLGVTLDQRWL

SEQ ID NO: 28 - protein, 166 aa, Pseudomonas bacteriophage F99/10
LLTTYSPRDVVVTLAGIHSVTGYAEGEFIRIVKDIKPFIKHGSMDGEIARVYNKDQGWRVELTIMQSSPTNDILSMLYNVDIATRMGKFPLMIKDTKGSTSFLALTAWVEDLPRVSFSGQLETRTWILGCSEVAMNIGGNVDQSLVEQAILLGSSLLPALTQFGGF

SEQ ID NO: 29 - protein, 159 aa, Pseudomonas bacteriophage F99/10
MANTVLTYSPSDVKIVLCGYALTGVVSFEMSWLSRPYTMVRGIRGHHTRVFNRDLSAQIRIEVLQTSVSNDAFFSLVEQDRRTQSARITLSVKDTHGSTMMSTDNAYVNGYPSITFTDGIENRVWTIDVLDWTDGTVGGNQQVGFDVFGTVQGALSYLR

SEQ ID NO: 30 - protein, 123 aa, Pseudomonas bacteriophage F99/10
MFGNQRTVIHNGTEYTINLLPATRGISVLKQLTSLLGPSLAKYQADHDFSGAMKELFDNIDKVPVENLIQNLMLTVFKGSMAINFDTEFAGKYDLLYALTKDVIEFNFGSVFSLIGFAEAPTV

SEQ ID NO: 31 - protein, 50 aa, Pseudomonas bacteriophage F99/10
VAITHPLKLTTYGELSTVLTTEDLYNILEVIDVHDTITQVAKEHAEADKK

SEQ ID NO: 32 - protein, 788 aa, Pseudomonas bacteriophage F99/10
MITERIAQLTGELKFTVDSRPLTAFDKKLAGVEARLREFSKLTNKRFGVKLTLDTKTLREELAKAATQRVVLKNIAVDAAAVRLISEKLQERLNATPIRLKSVRLDLSGIRDQKNFVKTALGQTKVDLPVELGLAQASRTLYEWKKRTESRFKIHLNADISRSKLLQNARNTLRDVQGRLNGLAVATPQIRLSVDRAHLRREIQDVLEQIRREVRIRIDLESSIRGGGAGGSRGTAGHIRQGMGMGIGSELAGWGRGFIPGLGGAFAIMQLNRANQELQGQRLAMQAVGGGVQGGQELQATLRDISQRLGLDDRAIGSSYVKMMAAGQASNFDKTQVDGIFQSMAEYGRVMGLDGEAMKGSFRAVEQMMGKGQIMSEELKGQLAERFPAAVALMAKSQDMTIAELMKTMEKGELKSDALIPFARTLAEEARKGGALDAAMQGTAAQQGRFQFGWNRTIEAFAAGGFDRGMSDFFKIAAQGMKEALPLVTALGGGFEALMRPVNALVGIGGELGSQWENIAKQFNMTGTGLTLTTAQTLALLTPMGRLISAISWGALALEDFIVFLEGGDSVFGDFLNNNVQAAETFEKLASESSELKNNLDGIFSVVPGLAEALKGLEFNEMLVSTMRELAAIMEFFNSVVERFAIAGKYRDAKIAEAGGDRSTIMSNIDTMYAMFNPEDAKDKATFIGDRLVAQNIDAIQTETHTRATQSLTPDQFGYMMQRGQVRNEMEGALKKSAIDISFNLNVSGIDAQGNVMTTEAQERVREIVSNVLEEEISRASASYKESQ

SEQ ID NO: 33 - protein, 253 aa, Pseudomonas bacteriophage F99/10
MTIAIKRENGDLIWFDAVTEFGRQYRGSVSSNPIETGGKITDHITTENPVFTLTAVVSDADFNLNRPVINDNEAQTYKINNKEFVNTQPVTIPAVISTSRLDPSRIFPEVITQFIPPEIPSATVLPQKGDKVAYDIERQLIDMQRNAEVFSLLDFRDGIIWDQIERCIFTDLSFTENAETGSSLQPRMTIEAVTFTDTRYVEVRVNKGRKTAKKEKRDTKEGDTGASNATSQDSPTFKRSQMKEAQIRTQVAR

SEQ ID NO: 34 - protein, 118 aa, Pseudomonas bacteriophage F99/10
MSTTYIDTLPLYQDRKYRYAVAIEGISRVLQFYWNSRSRQWHMDIFDEELNPILTGLAVVPQYPIMADYAMQHIGFNGYFLLMPVNLEQVQYKHDASDIVPQFFELLYVNVDLEDDVE

SEQ ID NO: 35 - protein, 305 aa, Pseudomonas bacteriophage F99/10
VKQYDRVYKLTLGNTESGQGVEITNLHPDGSLNREGLQFRFDISKSSDNKKSGNSATVEIYNLSIATLNILETEYLTCRLEVGYKEMGTSVVLDGNVVETSTRKSGNDYVTQLILGEGYTALTETKLKGTVSPGKTVKDVIEEIRLQMPGVDRGAYTGLNCNNPIMYGYQLRGLAKDALNSVCEANNIEWNISGNVLNVTDVNGPTTKSVQMAPLVNRETGLIDIPFYASASGTAQKKDQRRRRGVQFKCLLNPELTPGVLVRVESDRLSGTFRINNVRISGGYRDNEWYTECWCSDLNQEDIDQ

SEQ ID NO: 36 - protein, 246 aa, Pseudomonas bacteriophage F99/10
MRRTGLQELLNLHSSTEGSKQYTAIPCVVLRVLDDFRRLSVDVRPVVNDLYKDGTSEEQPEILSVPVIMPGTANTLISFPLNVGDTVLCVFSQRTMDVFKGSATGQPHTPNDLRKFNMADAIAIPGLFTFPRSMNDPARHSWPHDTKDLTIAHNLMTGQEAEVRIKANGDILINSRKTISINAQNVNVKCASLTVDAAHTTWNGNIAHTGNYVQTGGTSTFNGIPFHTHKHGGVMPGGGVTAVPQA

SEQ ID NO: 37 - protein, 123 aa, Pseudomonas bacteriophage F99/10
MDLFVNPDTHDLVFINGEAPVTQRMVDIVAQRLKIKLYTFLGEWFLDDRIGIPYFERILGKSRSLPAVDAIFQSEIMRDPGVLEITSWQSGIDPHTREYSMEFTVRTTDNTESLPITFRMIGV

SEQ ID NO: 38 - protein, 487 aa, Pseudomonas bacteriophage F99/10
MAGITAEGLTIKDLDQILTDYRNVASQVFADLVSTGDEVDTSGNSALGRLIGVVAPSDEAIWEVIQMVYNSFNPAAATGVALDNLVSFSAISRHAARPTRAQVVLEGNIDTVINSPPAKMISSSTGRVFHLLQGVILTPKACSGVGIFPQTVGNDLTYELKMYVDDINTTSIKYTSPATGTVTSESILAGLAADVATNHGNTLTSYEQNGILFIVPIDPFNTKTFEEASNLSIQKVRKLGIAVDDVIGPVPQQALAIDTISIPIAGWDSVINPVPAITGRLRETDDELRERFRNSKFVQATNILESLIDGLMNVEGVEDVRIIENDTDNLDPVHGVPGHSFLPIVLGGIPTEVAQSIWLNKPFGIGSVGDTEVQVVDSLGYTHRVNYQRPVEVPIEIKISVTNTGSMPENIEDILRPRIVAYGTENYKIGDDVIYSRFYAPIMEIPGFQVNSLTIAKKGQTQGMANIEIGFKEVATFAAADITVTTV

SEQ ID NO: 39 - protein, 243 aa, Pseudomonas bacteriophage F99/10
MAVNQFDREDYLEVARERVTEQFKEKPIFDRFLQVLLSGKFDIQNALEDLQTLRSLDTATGKQLDIIGDIVGRPRGLVYQDIFNYFGFAGTERAGSFGSLSDPTVGAPWYSVGAPTGNAREPSDEEYRMILKAKIIKNRTNSTPEQVIEAYKFVFGVPEVFLEEYAPAAVRVGIGKILTNVERSLLFDLGGAGALLPKTIGVNYTHTEFQAGRVFATEGFPGGQGVGDLNDPTVGGILTNLVT

SEQ ID NO: 40 - protein, 671 aa, Pseudomonas bacteriophage F99/10
MADYSQLPIENIWSTGGDMVAPTPAQQQGGWGIQSVPRQWWNWKWNLHDTNLAYLLQKGIPEWTSTQEYIANKSFCTRGGFVYKAVRTHTGSDPAQVSANWVRAFADYTTASSALGGLTPREGGIPFFISATGASVFDSTAYGRGMLNVANASAARSYISAQESSVVLSNLSTVTRAANTVPYFNTDTSMATFNITAFGRGLVNAANAENARNFLGLANSAIITADPANRAHTLVYRDAAGNFNAGVITATLSGNATTANKLRTPVTINGVAFDGSQNIVLPGLDTSYAGTVARLHINGANLSSADKTTQLALRNKSDNDWISLAVVDDNILQFVFRSATNPVVQIGNEVILHTGNQFSLGPTLTDARSRLGLDRLTQGSSDTQVFPSTLNNGPYLTVQPTAIGGFNGSTNGWLFRFDANGNMTHGTVPAARITGLSNSAQIPATTTAQANSLVQRDADGGFSAIAINAYGTIVGYGSNIFSRASGTGNAHIGFQRANGTELGLIWGAQSNNSMNFRVAGGSTAVSITGLDMTVTGRVNATTLNASGNVNATGNVNAGSATLNTAGNITGAAYGAYGSLTNWVDSVYAKKGEIPNDIARAGAAWDAVGQYILAGDQSGGSGGPGTTRAGSQLKPYSTISYTAGALPAAGTYRCMGAFAGGGNQITLWQRIS

SEQ ID NO: 41 - protein, 125 aa, Pseudomonas bacteriophage F99/10
VEFRNVVKYKMGFECEVNHPQWGWIPFYACDYDDRAKLVYDAISRAVDNGEIPEPKDVTDRDLVVDARLWRDNELTRADRQVEIAIDDEDEVKEKAWRKYRSALRKWPEHKNFPAEKSKPKAPKE

SEQ ID NO: 42 - protein, 499 aa, Pseudomonas bacteriophage F99/10
MPNIMKPTGINAIWSENGQKVDPGAVKVGLGWVTELPPYQTANFIEYKQDLFNAHVNQHGIPEWDSVTEYQGNLSYTQGANGIIYKCLRTHSDKIPTDPLNITAGYWRVAFEDAGEAAKVQANLDRHVTNYNTLSGIGNVVIARQNLSVYSKAEGDARYAMRHGNGSNVFSVAPATQPTHAIPLSQLSTLVPPATETVAGVMAVATTIETEAGANDTKAVSPLKAAQVYLKKKDNLSGLSNVTAARANLGLSDTATMPSSTFLKAGSNLADVPNKALARSNLGITSSATQPETYFLRSAQNLADVPNKAQARVNLGLTGMATTDPAAVMMKADNLAGLANTATARSNLGLGTASTRNTGDFLSSGDNLSDLTNVQAARNNLGLKGAATLDVWGLPANTTAMDFQSNQSDISRGWARLPNGLLLQWGTGPGLSDDTRTNIQLPVPARILNVQVTVMGTFNNSIGPGAFMTDMWSNTGFRVSCNWGNWSYPFNWFAITSTL

SEQ ID NO: 43 - protein, 186 aa, Pseudomonas bacteriophage F99/10
MALTEQDFQSAADDLGVDVASVKAVTKVESRGSGFLLSGVPKILFERHWMFKLLKRKLGRDPEINDVCNPKAGGYLGGQAEHERLDKAVKMDRDCALQSASWGLFQIMGFHWEALGYASVQAFVNAQYASEGSQLNTFVRFIKTNPAIHKALKSKDWAEFARRYNGPDYKKNNYDVKLAEAYQSFK

SEQ ID NO: 44 - protein, 79 aa, Pseudomonas bacteriophage F99/10
MKKLFKSWKFWAAVGSATFMALEAMVHLWEPILPPGVFAAVATLVAVGVRISAVFVTAGKVEEAISETIEDGSIENDTN

SEQ ID NO: 45 - protein, 147 aa, Pseudomonas bacteriophage F99/10
MILTKLKNYALVVAAAMAAGFGYLSFSLYGDLAVAKNDIQSLQAASRQMEEQFQKERAGCEITTGRLEAHIVQMKSRQELLQGHLCELESLPNPTPRETQENATETISEPSTGDSLDPALTSLLDRAFCSAVPNDPYCAPGKPDRGG

SEQ ID NO: 46 - protein, 43 aa, Pseudomonas bacteriophage F99/10
VEQDTVKGLARAYILNTNSAAMCNSQLQTIKLWAEEQRALYGK

SEQ ID NO: 47 - protein, 101 aa, Pseudomonas bacteriophage F99/10
MESKDGKEGLIKVATQGVISLLIAILMAWSGFLSSSLSKQEERIFAMQRDMVSEAKLNALESRFNSRLESEISNVRREQQETNRYLILIMNAVKGRDTETQ

SEQ ID NO: 48 - protein, 104 aa, Pseudomonas bacteriophage F99/10
MTRKQDWPLVSAVGALFISLLVCMAILAFTAMTPEARFDSVRQTYEIRISESERRYELKLNRLQDQINSASYTQDRQSRLQYEELDSLKRKISELERRIKEKQE

SEQ ID NO: 49 - protein, 102 aa, Pseudomonas bacteriophage F99/10
MELSDVKKGQVVMVGSLDIDIPRPTFEKSNSMQIGVVIDTDSHSMNLNVKVLFEDGNVDWGNAVDMKLIYSSPESNKARNKMAKKVIQKLNELFDEVHRVVR

SEQ ID NO: 50 - protein, 106 aa, Pseudomonas bacteriophage F99/10
MSLQYMVSGDEHIDDYATYELSYPDLKATYNRLSKLDDSSFKASMPEVLHFCCFVAWIKEIPSSILLGDRGLIHLIAHHIHEGAEDDGPQAFKSLRHQFNTLMKLD

SEQ ID NO: 51 - protein, 269 aa, Pseudomonas bacteriophage F99/10
MSKVKDHIEEALRPASRENINLGDFVLTERPDGEKVPAFVVVIETPEQEKREGYVPLLVYFGNGRVGWRSWKEVYKTSLRIDPRLIGTCVWAEGAEAISQLEEQGVFSYIDEQELIKKCYDAWMEWPFSTAIVEDQEPTFGELFERESVFEFVSGFNKMMTGLEVVNRKWNTDLVTGEPIKRDALHMLMLVTTEIAEAAEGVRKDLMDDHLPERKMEEVELADAIIRIMDYANVRGLDVAGAMIEKIEYNMTRADHKREARLAEGGKKV

SEQ ID NO: 52 - protein, 52 aa, Pseudomonas bacteriophage F99/10
MDYWACADAVERAGCECCGSILPVEEIVNDGGMLVCCDCYFEMFCEEEEVNE

SEQ ID NO: 53 - protein, 381 aa, Pseudomonas bacteriophage F99/10
MSNSQDRVLARVVRIDDVKTHPNADSLDLALVGGWQCVIKRGEYKAGDLAIYIEVDSMVPVDNPIFEFLRGRNMVEQGGKEYSRIKTMKLRKELSQGLIVPVHAAGSPEPKVDEDVTDRMGILKYVKPSEQVVINGGNKGSRTGTSKLGFPNFIPKTDQARVQNIQMAYDQAHQKDEKFEVTFKLDGSSLTIWHKDGEVGVASRNVGFRLEDEKIGFFTAVKNFFKGRGWKRVIKKDSNHFTAMAEELNLGERLREFGLNIALQGELVAPNIQGNFEGVDKPEYYVYDIYNISESRYYLPEERLATLGILNALADDGEEDVKHVPVYMWDVGVPKDMQDVIEMASGESALNGKYREGLVFKSMSRDFSFKVISNEYLLKEE

SEQ ID NO: 54 - protein, 77 aa, Pseudomonas bacteriophage F99/10
MKIDIRDEAREVSEIVFGDNVACACGLKKSEYSDIPVYITDGLPGDSGSWIAIRDLLDAENLLLALERAIDLGWFNK

SEQ ID NO: 55 - protein, 47 aa, Pseudomonas bacteriophage F99/10
VSDVDISLQQVTHFTTDYFLVKAIDTAEESMQNTTTFNTTGEKHNED

SEQ ID NO: 56 - protein, 65 aa, Pseudomonas bacteriophage F99/10
MKHVIYREDLIDLLRDRMKLQALEAGGVDNWDWYEASLIDCGYFDDDGRELEVEALADCFPTVGA

SEQ ID NO: 57 - protein, 161 aa, Pseudomonas bacteriophage F99/10
VEESKATFKDPYPRFFDASRRYGETNDCMVVSFAVVWNTTYEKAHQHLKVKCKRGYRQGATQKRFSYADTWCPKTRMLYREDAKDKTLRQFAEENPEGRFWIAVKGHAIAIIDGVLYDHTNDKRRTIWHCWQVWPGEAPEKIERKPDPISPPVRKAPDWYV

SEQ ID NO: 58 - protein, 84 aa, Pseudomonas bacteriophage F99/10
MEIISRGTLPQEALFTAKCHHCLSILRAKRSELEYVSFSFCRPGETGYYFAECPVCHEEVTAWVAVPVTHVAPPTTEYVAKGRE

SEQ ID NO: 59 - protein, 129 aa, Pseudomonas bacteriophage F99/10
MDQLAGFMGEPFVIAFDYDETISLYPLAFRVVMDTFRGFGGAFNVIVVTARHPDNSGELEWLRDYGFPIYFTAQKAKRPFMENLGIKVSVWVDDNPFSVDNDLPPWTAEQYDAYLEAKKQRAINRGSKA

SEQ ID NO: 60 - protein, 221 aa, Pseudomonas bacteriophage F99/10
MSEIIKVEVGDRVVLKAYCDTYTGCAKRWAQAHGRLHELLATGFVEDSWVHTDELAGGLKGTVVMTELGLKEECCAVRLDAYTDHRAVVVVDASDLYIACKAAKAPVSTLDEAFGCDHDYLMDSPANAQRLNESVEQLRTGQVVEVDVPMSVKQDETPPVVVHVVEKIYDRKGNVHLILQYEVAGALIRTVVEQGELIYFLDEMQGMYLTKIQLEVNNGVV

SEQ ID NO: 61 - protein, 55 aa, Pseudomonas bacteriophage F99/10
MELYDQWRKYMSVVILEEEDNERQCMRLIEAVGELDPYIQDFLDSFSIKTEGGVV

SEQ ID NO: 62 - protein, 98 aa, Pseudomonas bacteriophage F99/10
MSMSGDSVIKAEGMESYFISHWDGWDSMDTACFGFYIKPEYVLDPDIRKLEPSFLELDFERCRFTFWGNADEGLEGKLMEGKMHIMAPAFEYVFFKEV

SEQ ID NO: 63 - protein, 140 aa, Pseudomonas bacteriophage F99/10
VARQAYESASDRAVEEAVRSELEGRWKCSLHKLPRAHYMDWAACRNGKVVSFVELKARNNEMQKYPDFFVSQMKWLHGIEMQRVFDIPAFLVVKWTDYTGYVKMTANGVNYMSMGGRIDRGDWQDQEVMVHIPLKDFTRL

SEQ ID NO: 64 - protein, 42 aa, Pseudomonas bacteriophage F99/10
MAKKNPVFKFLNTVNRPSVERDKTKYRRKPKHKQKERLNEEG

SEQ ID NO: 65 - protein, 63 aa, Pseudomonas bacteriophage F99/10
MKKGDKVRINDDADTIFRGRVATIIAVDEEGCVIDVGSYEDESGELIEYLHLFFERSELSKQV

SEQ ID NO: 66 - protein, 81 aa, Pseudomonas bacteriophage F99/10
MNGPECRWCGEKTEAEFVDVGLGWMQQVTGGMCHRCGGYENGYYQNDGRLTEVEFATYWSGPFEDHADFSPFNHMREGDSP

SEQ ID NO: 67 - protein, 61 aa, Pseudomonas bacteriophage F99/10
MRATVRNHNLLYIYFHTFSEMNEWLTENAVDQWTVTTLGSGYQVAVPMDRAMRDQYASERG

SEQ ID NO: 68 - protein, 620 aa, Pseudomonas bacteriophage F99/10
MSKMTVAQIAAMHGIDLYSDHKTACPQCRKKGADNSGDNLKVYGTDRNTGEHKGAYCWACGYTLLSEEQERDARGEDEEEWNSVGTEFNAEINAQIKEQCSYDPRGYRGLSKETCQYFGVLHGFDPETGEIATQLYPTTTNYELTGYKQRIMPKNFSEPIGETGKDCELFGQFRFKNSNSKKVLIVGGEVDQLSAFQMLKEYDDRRAGGKSDYEPTPVVSPTIGESGAWKQLQAQYEWLDRFEQIILCFDSDDAGREAADKAADKLPKGKVFMMEMNRKDPNEYLKAGRQSEFVSAFYRARTWTPSGIVGSDALDARMYEAVQVEKIPLPPFAKKLQKAMAGGIPLGRIVNIGAASGMGKSTVVDEFTLFWIYNSPHMPGTVTLESDCGEYAIKLLSRKVGEKADLYETVEEKVAFLDRHRDARYDLWHKEDGSPRFYLIDDRDGSLAALKAQIEQLIIQFECRVIILDPLQDILDGLSNEEQSVFMRWQKGMTKSHRVTFININHVRKSGGGQKANSAGAELYEEDFQGSSSIFKSGAANILMWRNKDAENEFEKNLINVKLSKCRWTGRTGMMGNWYYDVETHTIWDLDDYLDRYPDKRREYEAWMAQKEEEGRDTEY

SEQ ID NO: 69 - protein, 666 aa, Pseudomonas bacteriophage F99/10
MQQRFETIEQYLEWMGNNNFTNMTWDIEATGLLDETSIDYTASPYKIKPSYKHHCIVVEEHGGNILAFYDGPTYVFDGREYTERLPKASSMLHTEEVVTLKDYTPVEYIHLPLKEFKNYVLKRKIKRVVAHNMINFDLMSMKLVEDMDFTIGVEHRDGGLTTWSADTWMGKQVVFDDTLVISKTCNPDLFGGHSLDKLSRRAGGDTKIDFRKHLAPDVRFLDFAADMLYYCIYDVKANTAVWHWLQDHEDYQLSDRDNYIKNWLSPIQLEKKVAEIITYQEHRGFVLNVDLCEKAVKDLDAKMEERRARVEPVLPPRPATKKFMADYTPPKRQFKQNGEITSYLQKFIERIGAQLKEGDDRTMIFEGKEYKLPLPADVPLKTEMPAKIGDTTHIKQWLMGEFGWIPSEWKETDLTVDQKKIKLPMENIVAKIDRWLDVTYSTAYKEERLDGFGDYMKITPRSTRAYVRQRLIDRASKGSCKVLTNPSFTKGQEKEMCPDLERIAEQFPFAKDVIEYLTFKHRRSAILGGGMDWDEMEDGEEPEKGYLASIRQDGRIPTPADTCGAATSRMKHRKVANVPRITSLYGAELRELFGVGDGFFQIGYDFDSLEARKESAYCDQYDPTKEYCKSLMMEKPFDVHTMMAKRISEIIGRQFNRSPAKNVKYG

SEQ ID NO: 70 - protein, 159 aa, Pseudomonas bacteriophage F99/10
MGRYARAGRSQAKMTAKPEKYPQGRFKDKPCRWCGTVFSPAAPSHLYCGDDCNQLAHDDARLKKAYGLTLRQYRAMVEEFDEKCRICGEEGFELVKGQRLKLVIDHCHETGRVRGLLCHNCNRGLGLFQDSIRNLKSAAEYLGRCNDYRNHGESRKGVE

SEQ ID NO: 71 - protein, 229 aa, Pseudomonas bacteriophage F99/10
VAKTIGADLQTGQLVFDAFWDAAFPLKALKDDLTKQWEANGKKYIIGVDGRRVPTRSAHAILNSLFQSGGVICAKRAMVIHDVLLEKEGLKVDFFKEDWKNKPEFCQQMIAYHDEAQLEVTAKSVSFKMFPWSLVGGKPEGEKEQEEAEKKLKALAQAYKDEQLASTGKVWSDIAHYSKGEGGVFVAYCRAGELATKAVRAAGEFYSTPLVPIELTAGYIVGRSWKDCH

SEQ ID NO: 72 - protein, 132 aa, Pseudomonas bacteriophage F99/10
MTLAFIIYLVMTVFPALSSAGSFALIVTIIAWVAGGFVYLASIGGRENEAVKATLKNHLRPLTFKLFLPIIVIGHLVPSSETAWWMVGGYAAQSLYQADATQQVLSESTELLEALVKRAKKETLKAVEGSSE

SEQ ID NO: 73 - protein, 55 aa, Pseudomonas bacteriophage F99/10
MNTARLYVYGKSSMVGITVDNKANREYYTSKGFEVSETPLAHKSVANKYKQKGGK

SEQ ID NO: 74 - protein, 236 aa, Pseudomonas bacteriophage F99/10
MSGVIPGTIVKLTQVGCDVTVGWPKEARYVGAYAVAVDGRDIGLPEGEIRFCSLHWSIDRDVNDGLGDYQSMLADNDRFEIVAIPGKKYYVKSAAERPDLISHYLVTSEPALYEGFEPCWLKSMLEGESPFCMLFKGRVNISGDISDDPKLQTLYPELVLEEFKEEAEEAIEAPVNEEKKEKVAKPAVMGYAVLDVDGFPLKFTITREEARSTKRWWGGKAEGVSIVKLIKGEEVR

SEQ ID NO: 75 - protein, 334 aa, Pseudomonas bacteriophage F99/10
MAFKLNVTTNTQSGNGGIRKEVDWDALNNHVVEAAGTAAKARSIPGYISGIIDLGEQEQNDAEVVFTGTAEDEIQIIKEYPNTYFKDGLDKQTRKPVRLKCWPQRDMQQIAITVDFPQIEVDKSLYLTGNSNKSPLRVLYNGDFTLPGQKTKIVGRPFTIKEVKHPNGKWAFAKNSMLHKLAVATGVINEDELFTKDRVGELLGKVAQFQVRVWMKPGKNDMKFLTEDISLVGMVPEGVPVPELDEKYIYGVNLYGENDEEAVKQLRANVINTIKRAKNYEGSDIKAMIEAVEAARGGNRSSGDSEEQAEAKEETKAAPKVEPVQTNVDDDIPF

SEQ ID NO: 76 - protein, 77 aa, Pseudomonas bacteriophage F99/10
MQINLGPIFLLAAIILCVLKSAGVLAISWTLALMPIWIPFVIMLVVLVGFGVVAGVLYAIGSRSKVKYSFKNNLRKK

SEQ ID NO: 77 - protein, 73 aa, Pseudomonas bacteriophage F99/10
MSTLVIVRVPEYILKGPSVHNQFSGEVWERELFNDLKKAAKSITKGEPAYVALPNKVNPETRQQEWDIQVVQF

SEQ ID NO: 78 - protein, 350 aa, Pseudomonas bacteriophage F99/10
MSEKEEDIVLIDGDLIAFKCASVNETRSIIVKNKLTGEEETWKNRTTWRENNKDSEGFDEDNFEIEDHQDPKHVSYGISVVKTMIDRICRQAGCKQFKILLSGPDNFRDAIPLPKEYEITKGKKTFTRGGRYKGKRTGQIKPLQLGQLRQYMIEAYDTIIHPGEADDLMAEMMYKNGVSYSRGETKQRVIGATIDKDADGTLGWLCNYEREPVQVKFISGLGSLYRDSKGKVRGEGRKFFYFQLLFGDPVDCYRPADLCIGKDFGEVAAYNIINPCESDKECWQAIYDTYKSWYPEPVTYTAWDGTEHTKDAVEIMQMYCDCAHMQRWAGDRVDCRAVLAKMGVELGGVE

SEQ ID NO: 79 - protein, 187 aa, Pseudomonas bacteriophage F99/10
MSVRPRPWEDFPGIWKTESAFLSWVRGGIRRYLWSKNPVKLEFAKSRRIKIANTNEKSKLRNPTVWGYVCEQCGKETPQANVEIDHKTGEFSLKRVEDIQSFVEGVVFVRMEDLAVLCKPCHEIKTYAERYGLTLEEADIVKQAIAIQKQKGYDKVFLQEVGIKPASNAELRKEQIIEYLRSKKEGG

SEQ ID NO: 80 - protein, 132 aa, Pseudomonas bacteriophage F99/10
MNEDRVYIVVRDEAPEYMVPTLVAHSILGADMAMVLLGQDRAVPSTDLPSRPYMHAAAKTAIKWVEWKQWSFRKIVVRVSDKEYNKIKQIPFVYEGYERTICNGEGSCLVVPPLSKEETPNVLKFAKLWRPM

SEQ ID NO: 81 - protein, 78 aa, Pseudomonas bacteriophage F99/10
VREKLLKIMRKLPIRVRASIALIWISVFFWLPVVTAFVAGAVDFFYTAKAQLKEGYSILLDVAKGAYQCIKTGEELEL

SEQ ID NO: 82 - protein, 145 aa, Pseudomonas bacteriophage F99/10
MTSLATYVIRHKKTKELWTTPKGKRQWTTKGGAARAWRNAYESTTLGAYYAKRDMERWPDLNIPLIVGAAPARLAGWEAASFKNQSAFEIVDIAESLKHESQLVLDLLKDVIGFEVPDHIGDGYVRLTIKTSTYDDIIKLLKEAK

SEQ ID NO: 83 - protein, 55 aa, Pseudomonas bacteriophage F99/10
MSMTDPRAYFIKQELEEATKLLERALNLLDNVHCYDTDVYEDIAAFLYGQECEEE

SEQ ID NO: 84 - protein, 60 aa, Pseudomonas bacteriophage F99/10
VQRDISKTIAELRDLIEAVSMLDEALVMMQKNGLYDTDLYKRIDAFLYYQPGEGEWEEVE

SEQ ID NO: 85 - protein, 259 aa, Pseudomonas bacteriophage F99/10
MSSKKHFVISDTQCKPGISLDYMEAIGKYIVAKRPDVVIHIGDHFDLASLSSYDKGKRSSEGRRYAEDVQVGREGLDRLLKPLWELQERQRANRKKVYQPRLIFTLGNHEERADRAANDNPELYGTVGSDELGIQDYGFEVVPFLKPIEVDGIYYVHYLQNHFTGKPLGGTANNMLKAAGHSFVMGHRQLLDWAIHPTIDGKQRLGIVTGACYPHDEAYKGYQGNNHFRGCVMIHEVKDGFGLPMPVSLDFMMEKGGFK

SEQ ID NO: 86 - protein, 60 aa, Pseudomonas bacteriophage F99/10
MTVYKFWCEWDIGINECLWRDYYQMEEDVAKALSDCGIEDTIEELEGAGLLGFDSVKVIG

SEQ ID NO: 87 - protein, 69 aa, Pseudomonas bacteriophage F99/10
MAEFFLGAALAGLFFMFSITASFTAEDIEKVTSTCENNEGVKYFGVDFFGDGAVHCNSGAIFKIDRKSK

SEQ ID NO: 88 - protein, 111 aa, Pseudomonas bacteriophage F99/10
MTDFNITPEQMEEAMAGMNPEQRALVEKALTDRKSLEDSIVTEDGELDYGMLARHIRTSLGDLPLVMGGPDFLKLMILVAAMPETKDDLLTLHMNLSFILDCIRESISDEE

SEQ ID NO: 89 - protein, 71 aa, Pseudomonas bacteriophage F99/10
VEEIVKDEAALSGDDLMVDSAGLDALLAFLESQFKGPKGVLKGYVTMRVMCAKIESLDGFQELKDMEVNFE

SEQ ID NO: 90 - protein, 316 aa, Pseudomonas bacteriophage F99/10
LSNDIIDVHAGQPISLVQRSKNPINIQYWDADTIPYGTVLVVTEERGDIRKGELVVRLASSADDEHSVRVCRFSDFFLLMERGYDAASLGDVKQAYDVLFEDHPVTTFVNWDRAQPLTNSERYYGDFLIGGDPKGMPLFNMAVLKNVLSPYTADDEELSAMSGNPETVEHKEVDELSERDEALAEVDRLNEELVALGKKVVFANLEDYLGKENYATLEAMANHKEAVGSGGSSSYYTVKVNNPTTKANMPYFAECNDIIEALDMRFGQGNMFKALWRAAAAQNLGKLKAGNDVIRDYEKVIFFAQLEIDKILRERG

SEQ ID NO: 91 - protein, 321 aa, Pseudomonas bacteriophage F99/10
MQISAKVIQHSYRIGSGTKNHRFITTFELEYPRFIHSELMTHRLFSRNAASSRAIPVAHMIRQVEENPAMPVHWGMNQPGMQAEFELSECLQRSSQYLWKKAAKSAARIASALNKMGLHKQVVNRLLEPFQMMKTVVTATELDNFFYLRCHKDAQPEIKVLAEKMYEALLKAGPAEALYDGEWHVPYVTRFRIGYGKLRYADCNGQELSVEEAIKVSASCCAQVSYRKNDETLEKALVIYNRLVDTKPVHASPFEHQAKPMLEPHFWCGDCQQQPDWEDGVTHADREGNFWSGNFKGFIQHRQLIEGHVCNEFYGPEKEGV

SEQ ID NO: 92 - protein, 114 aa, Pseudomonas bacteriophage F99/10
MAEYNLSLEDLMLVDGFKEAFQSNNEKVVREHLWTNGMDVKNYSYEMVFCQHRTLIGRVVEGLRFSGFERTDKEWLSLGCASLEAHIAACDDSNLRFTLRKMRPEGSTEATFHN

SEQ ID NO: 93 - protein, 348 aa, Pseudomonas bacteriophage F99/10
MEVTKALVDEADIFNKITQIRTPTESYARRYPVIVELANQQLEEKLWFSSEMKVELDKLNLKFKLEPHQLHAVKTVLQLFLKYELIVGEEFWMGKVVRTFPRPEVKLAASILCMMELAVHAEFYNQINVVLGMDTDADYVAYKDDPELMGRMDWLESVLGDEDDVLSVIIFSLTETALLFSSFAILKSFQCNGYNDIPVIARGANQSAVDEDLHGVVSAEIINQYYAEIGRPLSEDTRRVEKIRQAIDHVYAHECRIVDMAIPGGELNGESAENYKAFVRYRLNVWCRRLGLEDHFENDDTPIKDWFEMNTYAYKMIDFFTPGMGMEYELGWDEEELAKAWEEELKYE

SEQ ID NO: 94 - protein, 581 aa, Pseudomonas bacteriophage F99/10
MSKRDTFNYSEARKNSQAAGETPLWYTTAGYQLFMKKYSNEGESVRSRFETVARAMAQHAPTVYPEWWDEDEYTRGKDWEQVFFDVMWDGFVSPSTPLLSNGGLRKKGTTVSCAGGLMDNNLYDRYNVMTEIAVLTKHSHGTSFSLTNWPSEGDAIRGGESQGVMPVIRDVINVMEEVAQGSRRGSCAYSINPRHGDFWNVIDHLYKRTESNNVGWLLDDNWCKAMAEKDPETLKRWKRMMFVKLARGKGYFTFIDKMNRHLAEPFKRAGLRCEASNLCQETVLPANDWYTFSCVILNYNLELYRSWPKHLVFIGQVMSDCNISEYLATMDEVSIQDRRALEKIYRFTKDFRALGSGVLGFHTLLQRERFPVGSMDAMFLNNAIFKGMKEQAEACNSWLAEVLGEPEGCRGLGKRNATTMMMPPTKSTAELMAGASEGIGLDVAMCFTKQSAGGEFFRVNKVLLEIIQERGLDWEECARQINERKGSVQHVDWLTDHEKAVFRTAFEVRMEDYLRLCSQRQKYIDQGQSINLYFTSNDSPAYISYIHRLAMEDPNILSLYYIYSMRGAGDISRTEECEMCM

SEQ ID NO: 95 - protein, 48 aa, Pseudomonas bacteriophage F99/10
MNKFSEVYYTWSAACSRTNILIDMGWTATIRRDFTGGINPVWVVEFTR

SEQ ID NO: 96 - protein, 82 aa, Pseudomonas bacteriophage F99/10
MGCGVHAMNSKLRKEFDKWWGQDEQEELRKSCAKGWAEYIWMASRRKVSVELPAPEGGFIDIQKYTINRCKEAIRETGLEVF

SEQ ID NO: 97 - protein, 77 aa, Pseudomonas bacteriophage F99/10
MKEYFKKRLMQTSEPFDSATQAMDVAIAWGMAKYCEFTCVTADNRVISIWEYNDVEPDKPVFNGQQRILVPTFEEGV

SEQ ID NO: 98 - protein, 78 aa, Pseudomonas bacteriophage F99/10
MNQTIDKSRYIVFDNEGRHVLTLCEVAVYNLLKGIQWTKDEHGKIHVNGVTGVELGVRQGIIAEVFLYPGYIILEEVD

SEQ ID NO: 99 - protein, 104 aa, Pseudomonas bacteriophage F99/10
MDMFDKYMQVMYDRDAFSRRVGELEKEVAELKAKVAIAKCDMRVVKTLLEDIQWVYQDEAIYTLPGYVCPCCGESANYGHFQGSFDKGPCLLACVLSRSEAYEA

SEQ ID NO: 100 - protein, 61 aa, Pseudomonas bacteriophage F99/10
MKPNVVDSLGINMCYACGGKLYVRGVCTIYCPDCEKAAKDKPFVRMQLLQDIEDSKRVDNE

SEQ ID NO: 101 - protein, 82 aa, Pseudomonas bacteriophage F99/10
MATTEKIIEYVSACIERLQEDVTGYSENFRDRALSNRTGYIHGLITMAEMNEQVSIEDCDKLRVKLREAAEAVLNVLDSKIN

SEQ ID NO: 102 - protein, 161 aa, Pseudomonas bacteriophage F99/10
MNMKEIVQALIVVVALTLAAVGFVVGIHKLANKSVPAEDIVVSTEDGTINLGSFVKSEKLLYSMCIKVEDRKPACEFTTKDKVVHEVRQVMRPGEATARDIKIAVNAAVTYTGENGQKATSLIPPKGEFLPAGTPSEVHIETIDRLFDSVYNDYKQNFSKM

SEQ ID NO: 103 - protein, 64 aa, Pseudomonas bacteriophage F99/10
MKAQPKEVETLSLDKRPKAGDVVRLRSDGKTYEVNAVYPTAVGWEAVLRNMYDKTKTVTVSMEW

SEQ ID NO: 104 - protein, 79 aa, Pseudomonas bacteriophage F99/10
MARTGKCVNFLPVTPDGRVIVRFGKKRLGWLGKEGKKWYYYPYGCEGKIKSEGFKTLAEIKAWIRDPDAVWPGPKPEID

SEQ ID NO: 105 - protein, 83 aa, Pseudomonas bacteriophage F99/10
MVQWYVGNSLLNIRKLAMTSRWKEAVYRKYSVRRLRQELEEFKEARRFAPNQRIRAWFDAHIEFLERHLAIRESGQAYPDDLW

SEQ ID NO: 106 - protein, 328 aa, Pseudomonas bacteriophage F99/10
MQFNISKQLWVAKSERKGDYKGTLLAYMSQVDFNKDGSLAASFKKKQQTGMSWAGKNAETCFIDNIPISGHFIGDSVERWVTENKYFRVTDPRGFVLEVPTGNISTLLFNCTVIKGVIQEPCVWVRMGSQHVLLPEGSSLYKEAVSFVERKESAKTVKDMVAGDRCTLLSYGTEEKLEAIYLGQVKITWHLLAKKGRYSSRGWGGGRWGYHHLERELDRKEFTEKDSKWVSVFAKPVGKRWSIHFILSPKATDIQSGNVPDELQNLDLVNGVKWEYNEKDDRPSSYYSVPDRVVKCISVDDPLWDKLHSSSEVRWTREWTVVGAEWRK

SEQ ID NO: 107 - protein, 57 aa, Pseudomonas bacteriophage F99/10
MKIDNGAEYEHWLANTKEFVSQMDATEIEKAACIAYLVSWYQRRVLHRIKREEYEAI

SEQ ID NO: 108 - protein, 157 aa, Pseudomonas bacteriophage F99/10
MLHSEAREIALQEMDKWSLLEQGWKFSFNRRLKRTLGRCNHAKKLIELGYDYVADNGLPAVLDTIRHEIAHAKAGPQQGHGFIWKEWCGLIGAKPQQYASTKEKVVTFPLRLAILHEDGTLEPLNHFGFRRTNMARKQVRGRPETLGRLVWVKNENN

SEQ ID NO: 109 - protein, 47 aa, Pseudomonas bacteriophage F99/10
MQAWNVYQNGQLIDTVFFDIMRAAEEVRKSLVNHDGYPSDITVEEVE

SEQ ID NO: 110 - protein, 95 aa, Pseudomonas bacteriophage F99/10
MDSLSVKIVLSELSYKALTQAFALLGRVLDLDEGLDDILNLIADEIAFRDGLPPFEDGCDKTEWMLRRWESLPVVSYNAGQDGPAVARSIEVKPA

SEQ ID NO: 111 - protein, 81 aa, Pseudomonas bacteriophage F99/10
VGKLMTIKVEDIVAIRGDLRKKLDGSCQYLPEQLVDGKFLKHTGTGEMWTGRVERIQGDVAKVGGGWRGIESYVPISEINA

SEQ ID NO: 112 - protein, 42 aa, Pseudomonas bacteriophage F99/10
MKMFFKTRTQARAMATNGRKVVDNGAQAEKRWAVKLNKKEAK

SEQ ID NO: 113 - protein, 102 aa, Pseudomonas bacteriophage F99/10
MAKSVSVDRKRSILDEAKDGSFFSVEFIKADGTVRKMTCKRQIKSAYANGQYATRKPTSAGKPHLYTAAEVLNMEEGKSAFRTINLETLVRAKVNGIEYKFD

SEQ ID NO: 114 - protein, 70 aa, Pseudomonas bacteriophage F99/10
MKQGTDLIAKVNFTARLPGAKRGISVKPGDKFWVTTPSYSNADFVGVARKGKTTSYLFTAKDVQTLFETV

SEQ ID NO: 115 - protein, 48 aa, Pseudomonas bacteriophage F99/10
MARSIKASDFDSSYQFEAAKRSERKESRKSRDNRKASRGRAFDFRDDI

SEQ ID NO: 116 - protein, 127 aa, Pseudomonas bacteriophage F99/10
MARRQRLPSWVQDQTEDETPLRDKIDPYLSKLGEVDKLEGQLRRVRDATDPDEYNEMAKVLKARRRKIMKQRARAYGLPEDEPTNVQGYSVPEEVHRRAILLSSVKPWMFWTILSFSIFVWFVLKNS

SEQ ID NO: 117 - protein, 223 aa, Pseudomonas bacteriophage F99/10
MHFTLNLVSKNSKTGPMPVSTSHNGTCPDACPLKAKGCYAAYGPTAIHWKKLSKGERGVEWKEFLKQVRSISRGDLWRHNQAGDLVGHDDVIDGIALMELVKANKGRRGFTYTHYPMNDFMNRQHVLSANRSGFTINLSGNNVAHADELADLNIAPVVTILPMDAENVSFTPKGRKVVACPAEKSDKVNCKSCGLCQVADREYIIGFRAHGTAKKTVDLIAKG

SEQ ID NO: 118 - protein, 112 aa, Pseudomonas bacteriophage F99/10
MDESVYAPFNQCKMMGLERTVRSLAAPNGCKVVLYQDHKNKHRIVIYDALGHGMSGVMVQADGEIHYKETRKASQGQNLTRQLQAQLTAWGVKWFPSQYQTTAGAACYKGDR

SEQ ID NO: 119 - protein, 122 aa, Pseudomonas bacteriophage F99/10
MRQLNKTQFKALGAKIDLALELAATGRGELMNGYGSTCYISNKAGHNILRVSYHNSRFVVYGNESVRVTGTALQAWMEWKGINLAAIASVSEYGYHPNLSIGHNDALKTLKAIESYQREPVQ

SEQ ID NO: 120 - protein, 90 aa, Pseudomonas bacteriophage F99/10
VTASYSVDKLGQRWAVIRTELSFRGERVTVMGFCVDRAHALKTVAKFKAWQAQGWPYTLKDDRKIKLDSLGHSCRMALKQDKPAIRRLEK

SEQ ID NO: 121 - protein, 64 aa, Pseudomonas bacteriophage F99/10
MKAVAQFKSEDYASGDSRTATVYEDVYGCYIVSVFGTSLSEPIAFHWGPFEDKESAIDGAKSAI

SEQ ID NO: 122 - protein, 98 aa, Pseudomonas bacteriophage F99/10
MKISAILKNNLEIYGPTDFMCTLIDYDPTLGEEEAIEARRFIANLLDGFITLHTKLRGELPEYDVAYSVNGGFGSNKCFQMRRLWWETVIEQLEAQGK

SEQ ID NO: 123 - protein, 74 aa, Pseudomonas bacteriophage F99/10
MTQANWCKGVRILGGKRDGETVLFTDAHFSESMGMAGGDPELVEALPMPAALRLLVKWNKLCKQMKLDYRYELL

SEQ ID NO: 124 - protein, 88 aa, Pseudomonas bacteriophage F99/10
MSILALTLTLCSAVQCDDYIIDHTLPGQAAECNARLVEEAEEWGDAWVSTNADARLTRYLSRFNIQVDPRFVFDYDFTCQLIAEDELP

SEQ ID NO: 125 - protein, 130 aa, Pseudomonas bacteriophage F99/10
MIAPRITNKQTQRRAAIIIRRVKYYESRWLRTVTFFVGAASENITERFAYLRHAEEQMSKLKAEFAAFPVEHRLKALGWINWNTYNDGLLEEWIHPDSDRAIMLEYDSTTWRPEACWETKVDSLSKLAML

SEQ ID NO: 126 - protein, 193 aa, Pseudomonas bacteriophage F99/10
MLLVHGTTEKGLKAIMNRQGKDGLAAPWDVSDHDGMTYFHDVNKAMEWMANEEEAELDCVYRCLSQAQLQQAMMAEGGKIYALVVDIPEEFEHSVEDDYSCPNMADSASCIPEDKFDPAWIVRVYESSVNVWAIPFIVSGILGNPMFQSYRLPENLLAVAEAVSKADAYCEDIMEIDYDEQPLSILEDFKENA

SEQ ID NO: 127 - protein, 81 aa, Pseudomonas bacteriophage F99/10
MSIIDRTEGNESPNHCYIVTGSIGPEFEPLLFATHTLAKKYAQHIVKYGKANDVFPPFVPVIETRHKADMNRFTIHNKIPE

SEQ ID NO: 128 - protein, 112 aa, Pseudomonas bacteriophage F99/10
LKLSQIFQEGLDYAIFHGTPWYMCVRLRELDLPINLDDVTRDIRSIMNEAGMTRQFIGDSWDGGVDDHFWETGMADAYVMTWQETIDYGSPAYAMWVQFWFFVIFDLARKGQ

SEQ ID NO: 129 - protein, 159 aa, Pseudomonas bacteriophage F99/10
MKDKTVVYRIECNNGEGPYVNGCMTNSSSTPERPVPEHDGIPDVRDFEFFAFTSPRQLDDWFGDEYDVLSFYSTARIRVYAVDKQHVRVGIRQCVFRKAEADCVQEVSIDQWVSMVKAGMLSAVVAQALSPVPPEQLSLDLEGDPSCTASKEILKMFGL

SEQ ID NO: 130 - protein, 171 aa, Pseudomonas bacteriophage F99/10
MNTFAYAHFVARQDKASGTSLPYATLFRIALRMAYRQPGVRQYDYSSLVEDVKRRELIQKRIRAEKSVVMAAVMRAIRTGFTVSVKDGSDGEWVVKKSTDIKEISDSLQSTDEDIIRFRKGDGPDNIVGSMWAIYGNSASEVIADWTENATMAMIMAPAERKMEKYAEIGI

SEQ ID NO: 131 - protein, 90 aa, Pseudomonas bacteriophage F99/10
MHPYQPSNLEGNTMATLIIGNVNYHNHRLVDEIAGDAGYKGAARLVDECTRKITLLAPSGISAIDAKERAEVAAMIGEYLLAGFEVSIQH

SEQ ID NO: 132 - protein, 56 aa, Pseudomonas bacteriophage F99/10
MKRQYTDSYQCKAIDGMISILGSKKVTTQVPPSMKASRNKLLKKMIKYVARAGWKP

SEQ ID NO: 133 - protein, 150 aa, Pseudomonas bacteriophage F99/10
MNTLIIRLDSAYSVQTVRSFLVEAVESIQNHIRDYATHTEYDSGLSPVAHNHRLAIVTLDEDCRVFHIQCESPDLYLADPRIVFTDVESPAYTTPVNEIEEYSYMTAWQHIRQKDMTAKDRLSGWAILFASKENAIDIDPRPNLKTQILH

SEQ ID NO: 134 - protein, 96 aa, Pseudomonas bacteriophage F99/10
MNNKYKDNIIAEYCHFDGRRPVLSLAARWVHYDSRVVKLAALFACAGYGRPYKDCIRAYKDAKQREKDMRNPAKWKLSRATKRALRARLASKKKLK

SEQ ID NO: 135 - protein, 64 aa, Pseudomonas bacteriophage F99/10
MQATYQALKTLRDACEAAKDEKGTINGNKLNSLRNKAVKEMQAGGETYSDAIAMAHDLIKKYRK

SEQ ID NO: 136 - protein, 76 aa, Pseudomonas bacteriophage F99/10
MHRASSWRLRIRSAQGWPVNWYPRCSGSSIRRRVAQRSFCRRARVAFMISPRLGLSEWLATKGCEIRPTMTAPLLA

SEQ ID NO: 137 - protein, 86 aa, Pseudomonas bacteriophage F99/10
MVNYLILFFVIAMVYCVIGALVSGMLLMLKEASSDLKEPTRKEKDVIYVLGAIWPISLPFIAVGIVLGLPAMVIVKAVKRLIKNDY

SEQ ID NO: 138 - protein, 217 aa, Pseudomonas bacteriophage F99/10
MTSNIHANNARSPIGEEMHIHYAKGVFHAMRQRCNPKDRIYTGASLCEEWSKPRAAGFESFYEWAVYEAGYSDGYQLDKDILFPGNNLYAPHTCAFIPQYMNKLFTNCGGTKRVHAKPKPARTLPLGVQINYYRKNGNPSYTSQCRSLGKQATLGSFRTAMEAHVAWQHAKIAAIHECIDLYQMEDVHSVDIIQALLGRVDQLWKDIDAGRETILLQ

SEQ ID NO: 139 - protein, 52 aa, Pseudomonas bacteriophage F99/10
MEDNIQAPLAASAGGKFATVYEAIVALGVEGAAAVYRVGVGNRLTTARPSAW

SEQ ID NO: 140 - protein, 88 aa, Pseudomonas bacteriophage F99/10
MSEQYWYPAPIGCIKSLYAVALEAWARDFWGSENLNKILRHNGFSPCQSMEKVLQYMDQINEEYCNLMINYATREYMEEQRQLESLHT

SEQ ID NO: 141 - protein, 134 aa, Pseudomonas bacteriophage F99/10
MKTKEIDVSNFTAEQFDAFLEYCQDAQLKVGEGVVDKIREWMEHPISVDGPDDSPRCLYIRDHSEDRFISYGTGLRSKWQPDMYALYRPTFQTKCVMTLGEADKYVIVGGKPLSLDELQATLAKQGVIVTFGRV

SEQ ID NO: 142 - protein, 138 aa, Pseudomonas bacteriophage F99/10
LKERLVKFYTIVKTPEENIAVQQHLKAYGIEFGSGNGFMYDKAQVLLWVGDNLLDYTRKSDGSPMTFLWYEEELKEAIGYSKSTYDFRRVDFHFVTEKKVTAYTLHECDTGPTTELNGTYTLQALKEIIADMEEENEN

SEQ ID NO: 143 - protein, 228 aa, Pseudomonas bacteriophage F99/10
MFKKLFAWFREEERNEEPKLLEARVEECYDPASRPIKYMSAEQENRLKELEGKIGEPVKAICETFFDWKRWTVYRDWRHAFQSQSNSENVKITDCKTGTTLEWKAVSDTGRVGIIWKDLPLLQHDTRLGLLYQEWMTTEEREYATLMARKAISVLAKKKDHISRVLSRRKERQNYRAGLVDRALMMEKYVGVQEGDEWDIILKGARERLEQTITTEGLTMDWERFTLP

SEQ ID NO: 144 - protein, 92 aa, Pseudomonas bacteriophage F99/10
MEQVGLLILVCIVVGVVCLLFYSVIGMFVWESLRPLLGWRGESTERRKKEARAVLAGIFWPIAVPFMAMLFLVSLPRKVWRLTRVAITGEED

SEQ ID NO: 145 - protein, 103 aa, Pseudomonas bacteriophage F99/10
MEIIPMLFVLALAWGIVFMWTYMGITEYFKDNFPASATKDHREGIEAFAIVLGLLWPITFTVYASFLLLYATYSVLKVVLLPKWALSIWNSRKLLKRIAPWNK

SEQ ID NO: 146 - protein, 120 aa, Pseudomonas bacteriophage F99/10
MNSNSIAPLIKEGMRAFLENEEEPYMCYILERLALCSDSSVTVSDVGRFKGWLDKTFGIGPLNSVMHLLDEVADSCVLSMFENNPPNKDWEDYWEGWAIGRAWCNFYVWAYFDLIRKGGE

SEQ ID NO: 147 - protein, 71 aa, Pseudomonas bacteriophage F99/10
VIFDKYIISLDTFKDGTEEYVLFRRGDNGFITYIDSFATKYSAIDHAFFLEYNRYPSAYEEADLYNWVVMC

SEQ ID NO: 148 - protein, 113 aa, Pseudomonas bacteriophage F99/10
MFKKLVAIAFTLALHSCGVAPAYAEDTSGRDAEYCSAVVAHLTSMPMEAMLSALDVRPGDDPVIRVANTMYIYTCKVEGNLVLVKGDFEKGFYRAFLVQEDDYNYYISREEML

SEQ ID NO: 149 - protein, 167 aa, Pseudomonas bacteriophage F99/10
MLTCEEIEELKSRIGANADRLIHKVERGLVPPLDTSRGRKPSFFFNAVQPEMYEVMVELDGDYPLWVDDVLQGVARLDWYRPDERSIPLSAKKLLTIFASLSNINAHTISHLLRVEARQANRYYKAAEFAHEKLIDGFCKDELRCMKYPETFVYPKPDVPQTDQEEG

SEQ ID NO: 150 - protein, 125 aa, Pseudomonas bacteriophage F99/10
MYTVEVPEVPVVCDITDPNRRCMQWIRARIIRLKNNQSTGFEDIYVLEPSHVDLECRWREENDPEDYVRWVVAWFDVDMCDGQKFRQLIRYDINNMFKWYGPANLTCEGVFTIEKSKVCPPYVDM

SEQ ID NO: 151 - protein, 132 aa, Pseudomonas bacteriophage F99/10
MAEIYLPSPGFNQYQITETLGATILPEEELPDEWEEARSIASQIHPAWNSVRNDGEPVLSPFARRAHTRNVFQVLGIDLNTPSKFLVCWSKTDHNGIPEGGTRTAWQLASSRGVPCFNLYRHADRDRIMAFL

SEQ ID NO: 152 - protein, 103 aa, Pseudomonas bacteriophage F99/10
MSIDLDNLTAYELLYLQAQIIEKLRLKFEESGEGELEIKDVYRGMLLTMGSDGYTIPRGCECKVVGIDHEDNFYPVLVEYTNQEGDYRHHWITYGELGQMVRR

SEQ ID NO: 153 - protein, 49 aa, Pseudomonas bacteriophage F99/10
MIRGAIKYKGTWLAPGSEAFQLYQDKKLDKLDKHLAKLDKAFKKLEGRE

SEQ ID NO: 154 - protein, 159 aa, Pseudomonas bacteriophage F99/10
MIKYRKGDLIAAFKNKELHAIAHQANCFNTMGSGIAKQIREQFPEAYEADQATVKGDRGKLGSLTFTINEYGSIYNLYGQYNYGREEGRVYTQLDALGQALYTMSLFLEAEADARAIPTSELCVGLPKIGCGLAGEDWSNVEPLIEETLGQFQVYVYEL

SEQ ID NO: 155 - protein, 65 aa, Pseudomonas bacteriophage F99/10
VVAKYYFTTFCEQGRPENKGHKLFKFRIWEKEYWSPFAAMNSMYSDIAHGARGAEVRFTSVERFK

SEQ ID NO: 156 - protein, 562 aa, Pseudomonas bacteriophage F99/10
MKILPHLSTDGYKIGHGSMYSEGTQLVYSNLTPRSDKIYRKTHATDFYDGTLKWVGGRAAWMEIVESWEGFFAAEEENAVGRYSRFLTGYFGREMEAVEQLRALHKLGYLPLEVKSLTEGVSVPMGVPVLTIKNTLPEFYWLVNYHETLISAMTWKTATNATIAAEYAAMGRYYANHTGCYDDFLLSVQFHDFSARGMSGIEDAARSGVGHLTSFVGSDTLAAAIYAEDYYSATGLVACSVPATEHAVATSNILRIEKEMNDGEGEGGREEAERRFLVELMGKFPSGILSYVADSFDFWGVITDILPSIKDQIMERDGKLVVRPDSGDPVEVICGLGDIEVVESLEHWDIMDAVNGNDAFVLNFEDKYFKVIPTEWDQYEYVVGYKLEEVSEAQVKGAIQVLWETFGGTVNEAGYKMLDSHIGLIYGDSITTRRAAKILERLKEKGFASLNVVFGVGSYTYQCNTRDTFGFAVKATYTEVNGEGIAIFKDPKTDSKKKSAKGLLKVYRDQENGRFLRLKDNVTKEEEETGHLRTFFKDGKWNTEDLKNNDLESIRYRIKNGV

SEQ ID NO: 157 - protein, 72 aa, Pseudomonas bacteriophage F99/10
VSLSIWIVEYKRSAPEKRVVKVEEFDTKEELDARYKMMHDKFWEDFHSKKQPLLRLPCIYPVLTLPVEEVEY

SEQ ID NO: 158 - protein, 288 aa, Pseudomonas bacteriophage F99/10
MISYAVGCLHEMEGVMSRPWQEAKVWTFPGGEVGVNVAGIESHAFVNVKAQIKNSDDIMALLNVTEAIRAEMINPHMTLLLGYVPYARQDRRCNPGDAFSLKVFANMLNSAGYDRVIVVDPHSDATLHLINNVEVVRQSSVFGGLLNRSEWEQYQLVAPDIGATKRTEDFAKKTGAATVIRCNKKRDLQTGKIEGFEILNPSDIDPELPLLVIDDICDGGATFRSVSKALREYSKVLPDLFVTHGIFSKGIDCLLDSFGCIYTSDTLPQKEHEALTVIPVEYSKAERL

SEQ ID NO: 159 - protein, 138 aa, Pseudomonas bacteriophage F99/10
MQEKIMYIIRGLPGSGKSSFARILYHQIWESGGTASICEADDYQMEYGEYVWKAERVVESHNKCMEKARNSMKAGLDAVIVSNTSTREREVEPYIDMAEEFGYTVISLIVENRHGNKSVHDVPESTMEAMRKRFSVKL

SEQ ID NO: 160 - protein, 305 aa, Pseudomonas bacteriophage F99/10
MEGNLNIAMYKDLIANKLVTVKHFNGMSIIKYARKVFYENLWNEHPLLLEARGHVFDQHSGDCIVRPFEKVFNLGENGAGSFLHPKFRVRLIEKVNGFMFSVTKHNGSLIFSTTGSLTGDYVALGQKYVSNNPDDYIAGFTYNFEICSPDDPHIVEEEEGAYLIGIRDIFTGGQLSEYILDSHALGVTDHSSVKILRPEHIECSWEHAKGLLSSCEKEGYMVQTGLGTVKCKSTHYLGKKFIMRMGSKKVNAMYQDPAGFKQTLDEEFYPLVDFLVNEVEESCFVEMTDAQRRLLIETYFDMTRI

SEQ ID NO: 161 - protein, 135 aa, Pseudomonas bacteriophage F99/10
MKIDKNSWHMRLHRTFETPVYSAISSGWQIVTLCSYFWQTVFLVVWLALTVVALAAVVGSVLYSLALGPLTGYVLGGTLAVMGFVWIGIIAVFYGVWVFYRFSRFMSSKSSSKDGILVSYLKAKKAKFCPIVELK

SEQ ID NO: 162 - protein, 91 aa, Pseudomonas bacteriophage F99/10
MNDPVKDFKKTVMVVAAHYITQSGLTQREVAERCGTHQSRISNLMKQHVDKFSIESILEIVHKLGGYKMVASMELEEHNVLNFNIFPEEQA

SEQ ID NO: 163 - protein, 78 aa, Pseudomonas bacteriophage F99/10
MVNVLISRDKEDVKPKANTLVELIHDDGVPFIVLMTSDVKQDGTFEGVAFEDARWTDQFEIAQFRVFDGKVTLSNKED

SEQ ID NO: 164 - protein, 184 aa, Pseudomonas bacteriophage F99/10
MSVFFSSDLHFFHKNVIEYCNRPWTFEEQTEELISRWNSRVRLRDEVYHLGDFAFAGKNKLQAVLDIIRQLNGRITFLKGNHCDSRLWKLIEDSNLSHVEDIRDYKEVRIDGVKIVMCHYPFETWNTAHHGAWHLHGHTHGSLPSKGKRLDVGIDNHPDHQVFSYDEVREYMREQEFVVVDHHK

SEQ ID NO: 165 - protein, 143 aa, Pseudomonas bacteriophage F99/10
VWNEYKEQYSYTPVTTGEIKEVLARWELVQLQAESAVEEAIISYSRPYSFFEKLRGVDKWSPKELLKKDAVDHWLGVEGHLYREGKISADHYWVVDFHYERRDMLSEFKAMASMEPEREHLLGGAAMRLIRRINKIYEFEMEA

SEQ ID NO: 166 - protein, 186 aa, Pseudomonas bacteriophage F99/10
MNTQLGIAIEIALSAHEGQRYGETNFPYAYHLNQVHTVCVARNAPKDMDPGQAFSDLPYMDTLLAVCFLHDVLEDTELTEEDLESMGVMPHIVEALVILDKNRAESYRKYIEACRNHPVAREVKICDTIANLTNSVMSGNSKRIKKYSNQLSMLEREASVLENKARKKTTRSDKFKGYVGEQYSVE

SEQ ID NO: 167 - protein, 186 aa, Pseudomonas bacteriophage F99/10
METLEALVLSILLAFIGMFLDMEYSRLKYGTEPVVEFQASPGQIIESKRTLCEYRKPCRLLAEAVYFEARGEPEIGQIAVAHTVVNRMKHDRWPSTVAGVLYFKCQYSYTCDGSMRQGVKELDKWEAAKHVAYNALYGYTVDPTRGADHYLNERKVRRANNGKLPRWARKYKRTIKIGNHTFYKGD

SEQ ID NO: 168 - protein, 153 aa, Pseudomonas bacteriophage F99/10
MFNAKSVNVTTAIDAAEEFQLLDTSAIQIRSVIQFMDALTYKFNYTTGCFETQTREAKHISKLSFNTAVRLHNLYLVPTSTVTQYGFWAPAGAGYRSAEFIDLVVSPELMAKAQASKIVKNAKIQKDRKGNIHIQSMMVEFPNKDYARRYNLG

SEQ ID NO: 169 - protein, 402 aa, Pseudomonas bacteriophage F99/10
MSYFQRLYGLDKKGGFKEWTVEVVGEEDGSFNIVVKYGKEHGAMTSQVTNIRVGKQKRSVEEQAMSEAQSKVSKQLDKGYRAAKEELNDLPVMAMLAKPLDPAKYKEGYGSPKLDGLRCMAKKANGVVTLASRMGKPYNVPHIIKELEEIMQEGDVWDGELYVHGEVLEDINSAVKREDAYDKWMKAEKALDAYALENGEEEYDRLLNEVDSTSFIYGLRKRMEFHVFDIVKEGLTFKERLVDFQFKAATVAGIGKIRFVEYVFCSTFEELKRLHDVYRQKGYEGIMWRSPEGLYESGKRSSGLQKYKEFFDMEMQIVNYVVDKNGNAVLVVFDPVPQELLEVTYGDFDERKDQITNFENYRGKWLTVQIQSRFKKTLRAQFPTGKLIRAGRVIGGVFVPEE

SEQ ID NO: 170 - protein, 138 aa, Pseudomonas bacteriophage F99/10
VKVKHIKAYMEAAEAFAKCSDSTRSKVGAVLVKRNRIISCGYNALPEHLNGPLEDETGVTKAEVRHAEENALRALIRSPESAQGATLFVTHSCCKNCAISVVEAGIKVVYYKHEYRLDEGLRHLRENDVLVIKYEEDQ

SEQ ID NO: 171 - protein, 78 aa, Pseudomonas bacteriophage F99/10
MTEPTEPTVMRIDDVIEALQTLRTVYGNLKVAEIEHGDPTWSYYPPSVVYLTDTDEYYMEFACPEEGYYEEIAVLIGG

SEQ ID NO: 172 - protein, 70 aa, Pseudomonas bacteriophage F99/10
MKDVAGRDIEIGDAVAFCLGGTGMVMLVGEVVAINPKTVSVKAEAWDKWSGKPSVQVFLRRGDAVCKVEN

SEQ ID NO: 173 - protein, 89 aa, Pseudomonas bacteriophage F99/10
MKVVKRNGHKLELESDEINMLVGLLGHLSASAATTDLGWFMEDLYQELEVKSDPEAVNKYEQEFRAKAYGSDDPSDFVILIKGADGEYK

SEQ ID NO: 174 - protein, 219 aa, Pseudomonas bacteriophage F99/10
MAVKDLTGQTFTYLRVVGDSGARSNSREVLWLCECICGAILKIRTGALKVGDNKSCGCMQSKLLSSHGMYGTPTYNSWRTMIDRCTNPKHKSYKYYKDVTIDPKWKTFEGFYEDMGERPEKKTLDRKDSTKGYCKSNCRWATDSEQQQNKPASTRNTNGYPGIFFRNNRYVARIRYEGKRIYLGCYKTAEEAHKVYDDKGRELFGEEWKSYFDVSGQKR

SEQ ID NO: 175 - protein, 115 aa, Pseudomonas bacteriophage F99/10
LTSKNSDLSTQMIDKIIAKESVVGQYTVAKQKVTVIDYEEFSRLDFQPPATWFIKDASGYYIFVHTSQRAKAQAWIDEEYGKGRYTVNASRVQKKHNTGEGSKPAYGVATRQVRR

SEQ ID NO: 176 - protein, 92 aa, Pseudomonas bacteriophage F99/10
MSNLVWELVWEEDYEPDSRMGLWIGNPPSVEQLAEVLLGADWRLTEDKVEEAAHSLLKSGGYKVSQYHALSLDSFFADTGLGKEVEIDLEEL

SEQ ID NO: 177 - protein, 92 aa, Pseudomonas bacteriophage F99/10
MNSVWVIFGQLWDDYSGEFDLHMLGVLGNTKAETIRRVVSSYPGLPEPDEELLDFIVAGLIVNAECEVDIPCGKTGKDEWVMYSIRKKEVYQ

SEQ ID NO: 178 - protein, 61 aa, Pseudomonas bacteriophage F99/10
MATRTVHYDEWDCGTEADSEEPYDVFCGTDGDFEEKNFSRYRNHITCKRCLKLLDKKKEAA

SEQ ID NO: 179 - protein, 97 aa, Pseudomonas bacteriophage F99/10
MRDEFEAWFVRNYAAQIKDGHHGFTLDRYEHPPHQYIHDTPHHDWRIWQASRAALRVELPEKMEPTRNIYGNLIIGSYNAVLDAVKEALQQAGIEVK

SEQ ID NO: 180 - protein, 61 aa, Pseudomonas bacteriophage F99/10
MFELMQELEGQAIDNSKEGVYLQKIRKEWKYVEDYIHALEELALSVMPSELLKEIQEDCGV

SEQ ID NO: 181 - protein, 182 aa, Pseudomonas bacteriophage F99/10
MPVSCTQSVSNRYSILLPYVIKSLEELTEELWTLENAGQNDEVYITINGCGGQVETANAIIRAIKECQAPVHARLEGECASAMTAIALACDSVEIDQFTYFMIHAPSFGVVSADFRNSLRNAAFSSAWCDKWVDHVYSDFLTEKELERVKAGEELYIGGEELEDKLSDFFEKKRLAMEEISE

SEQ ID NO: 182 - protein, 118 aa, Pseudomonas bacteriophage F99/10
MKFNKAQREFFKDYAIQTVKSTLMQVAAQNGLEINQEALDRAMEVVNLEPLAEAAGTAFLERVDFKTLVKVDKFVRTEEFLSVAQAGAEVGEAVSGELSTILLPFFAMLGSGQKESEE

SEQ ID NO: 183 - protein, 155 aa, Pseudomonas bacteriophage F99/10
MQVINIVEYNPIVWLRSIHAHMKEGFRVVRSIEGYPVYGTLCQVQMFRQEGVSPEIEKELDGNEVIVQEWDVFSLLMGMQNAFDQGFRIDLEDPHFANMNFALKSVKMVREGAEKQTEEKSTEVAKEVPVEEVQETESEDKPKTRRRRTTKEKSE

SEQ ID NO: 184 - protein, 62 aa, Pseudomonas bacteriophage F99/10
MRCKCCDSELSFETPVINKHTGKEDDLCSSCRRFALNPTLDHEYFGGWYPSEGVTAPLPTGD

SEQ ID NO: 185 - protein, 107 aa, Pseudomonas bacteriophage F99/10
MTQERNKGGRPTNAELEARGIIQTDLKAGLRLLKKSFAENIRFLQEQSDNPEVSLQMRIKLKKELSDMFVAYYKADIALKKELAKGTESGDNENTEEDKTPGVVLAF

SEQ ID NO: 186 - RNA, 71 nt, Pseudomonas bacteriophage F99/10
ugccgcuucguucaaugguaggacgccagacuuugaaucuggagaugaugguucgaucccaucagcggcug

SEQ ID NO: 187 - RNA, 72 nt, Pseudomonas bacteriophage F99/10
gcucguauaguguaacggaugcacaacggucuucuaagccguaaggucuagguucgaauccuaguaugagcg

SEQ ID NO: 188 - protein, 136 aa, Pseudomonas bacteriophage F99/10
LKQCTQCKVEKPTTEFYFKGRKADGRLHSECKKCFNNRMMKRYEQRAKVIVDMKGGSCYLCGYDKCVAALEFHHMDPSQKDFEISKRWSMKDERIKAEIDKCVLLCSNCHAEVHYNEARGKIYNWTEAKVVPASGF

SEQ ID NO: 189 - RNA, 74 nt, Pseudomonas bacteriophage F99/10
uggacggaagcuaaaguggucccggcaucuggcuuuuaaccagaccuuagugaguucgagucucacccguucaa

SEQ ID NO: 190 - RNA, 82 nt, Pseudomonas bacteriophage F99/10
ggcccugugguggaauugguauacacaucagucuuagaaacugacgccgagaggauugaggguucaagucccuccggggcca

SEQ ID NO: 191 - RNA, 73 nt, Pseudomonas bacteriophage F99/10
ggccagauagcucaauugguagagcacccgaccgauaaucgggugguugaagguucaaguccuucucuggcca

SEQ ID NO: 192 - RNA, 76 nt, Pseudomonas bacteriophage F99/10
ggcccauuagcucagucuggacuagagcaagccccugucuagggcaaggucgccgguucgaauccggcaugggucg

SEQ ID NO: 193 - protein, 98 aa, Pseudomonas bacteriophage F110/10
MQGGKHRPRRQLLSGVSGVHQPRRGLSSPLDYIRRTGTNGETMRYYTGVGSRDTPNREWGILREVGRKLAEQGFILRSGGAKGADSAFEAGWLDYISN

SEQ ID NO: 194 - protein, 103 aa, Pseudomonas bacteriophage F110/10
MSIDLDNLTAYELLYLQAQIIEKLRLKFEESGEGELEIKDVYRGMLLTMSSDGYTIPRGCECKVVNIDHADNFYPVLVEYTNQEGDYRHHWITYGELGQMVRR

SEQ ID NO: 195 - protein, 49 aa, Pseudomonas bacteriophage F110/10; identical to SEQ ID NO: 153

SEQ ID NO: 196 - protein, 159 aa, Pseudomonas bacteriophage F110/10
MIKYRKGDLIAAFKNKELHAIAHQANCFNTMGSGIAKQIREQFPEAYEADQATVKGDRGKLGSLTFTINEYGSIYNLYGQYNYGREEGRVYTQLGALGQALYTMSLFLEAEADARAIPTSELCVGLPKIGCGLAGEDWSNVEPLIEETLGQFQVYVYEL

SEQ ID NO: 197 - protein, 65 aa, Pseudomonas bacteriophage F110/10; identical to SEQ ID NO: 155

SEQ ID NO: 198 - protein, 562 aa, Pseudomonas bacteriophage F110/10
MKILPHLSTDGYKIGHGSMYSEGTQLVYSNLTPRSDKIYRKTHATDFYDGTLKWVGGRAAWMEIVESWEGFFAAEEENAVGRYSRFLTGYFGREMEAVEQLRALHKLGYLPLEVKSLTEGVSVPMGVPVLTIKNTLPEFYWLVNYHETLISAMTWKTATNATIAAEYAAMGRYYANHTGCYDDFLLSVQFHDFSARGMSGIEDAARSGVGHLTSFVGSDTLAAAIYAEDYYSATGLVACSVPATEHAVATSNILRIEKEMQDGEGEGGREEAERRFLIELMGKFPSGILSYVADSFDFWGVLTDILPSIKDQIMERDGKLVIRPDSGDPVEVICGLGDIEVVESLEHWDIMDAVNGNDAFVLNFEDKYFKVIPTEWDQYEYVVGYKLEEVSEAQVKGAIQVLWETFGGTVNEAGYKMLDSHIGLIYGDSITTRRAAKILERLKEKGFASLNVVFGVGSYTYQCNTRDTFGFAVKATYTEVNGEGIAIFKDPKTDSKKKSAKGLLKVYRDQENGRFLRLKDNVTKEEEETGHLRTFFKDGKWNTEDLKNNDLESIRYRIKNGV

SEQ ID NO: 199 - protein, 72 aa, Pseudomonas bacteriophage F110/10
VSLSIWIVEYKRSAPEKRVVKVEEFDTKEELDARYKTMHDKFWEDFHSKKQPLLRLPCIYPVLTLPVEEVEY

SEQ ID NO: 200 - protein, 288 aa, Pseudomonas bacteriophage F110/10
MISYSVGCLHEMEGVMSRPWQEAKVWTFPGGEVGVNVGGIESHAFVNVKAQIQNSDDIMALLNVTEAIRAEMINPHMTLLLGYVPYARQDRRCNPGDAFSLKVFANLLNSAGYDRVIVVDPHSDATLHLINNVEVVRQSSVFGGLLNRSEWEQYQLVAPDIGATKRTEDFAKKAGAAAVIRCNKKRDLQTGKIEGFEILNPSDIDPELPLLVIDDICDGGATFRSVSKALREYSKVLPDLFVTHGIFSKGIDCLLDSFGCIYTSDTLPQKEHEALTVIPVEYSKAERL

SEQ ID NO: 201 - protein, 138 aa, Pseudomonas bacteriophage F110/10
VKEKILYIIRGLPGSGKSSLAEILYNKAWESGRQASICEADDYQMEFGKYVWKAERVAESHKKCMDKARRSMEIGLDAVIVSNTSTREREIKPYIDMAEEFGYTVISLIVENRHGNKSVHDVPESTMEAMRNRFSVKL

SEQ ID NO: 202 - protein, 305 aa, Pseudomonas bacteriophage F110/10
MEGNLNIAMYKDLIANKLVTVKHFNGMSIIKYARKVFYENLWNEHPLLLEARGHVFDQYSGDCIVRPFEKVFNLGENGAGSFLHPKFRVRLIEKVNGFMFSVTKHNGSLIFSTTGSLTSDYVALGQKYVSNNPDDYIAGFTYNFEICSPDDPHIVEEEEGAYLIGIRDIFTGDQLAEHILDAHALGVTDHRSVKILRPEHIECSWEHAKGLLSSCEKEGYMVKTGLGTVKCKSTHYLGKKFIMRMGSKKVNAMYQDPAGFKQTLDEEFYPLVDFLVNEVDEARFSEMTDAQRRLLIETYFDMARI

SEQ ID NO: 203 - protein, 135 aa, Pseudomonas bacteriophage F110/10
MKIDKNSWHMWLHRTFETPVYSAISSDWHSVTLCSYFWQTVFLVVWLASTVVALAAVVGSVLYSLALGPLTGYVLGGTLAVMGFVWIGIIAVFYGVWVFYRFSRFMSSKSSSKDGILVSYLKAKKAKFCPIVELK

SEQ ID NO: 204 - protein, 91 aa, Pseudomonas bacteriophage F110/10
MNDPVKDFKKAAMVVAAHYISQSGLTQREVAERCGTHQSRISNLMKQHVDKFSIESILEIVNKLGGYKMVASMELEEHNVLNFNIFPEEQA

SEQ ID NO: 205 - protein, 78 aa, Pseudomonas bacteriophage F110/10
MVNVLISRSEHGVAPKANTLVELIHDDGVPFVVLMTSDVKQDGTFEGVSFEDAQWTDQFEIAQFRVFNGKVTLSNKED

SEQ ID NO: 206 - protein, 184 aa, Pseudomonas bacteriophage F110/10; identical to SEQ ID NO: 164

SEQ ID NO: 207 - protein, 143 aa, Pseudomonas bacteriophage F110/10; identical to SEQ ID NO: 165

SEQ ID NO: 208 - protein, 186 aa, Pseudomonas bacteriophage F110/10; identical to SEQ ID NO: 166

SEQ ID NO: 209 - protein, 186 aa, Pseudomonas bacteriophage F110/10; identical to SEQ ID NO: 167

SEQ ID NO: 210 - protein, 155 aa, Pseudomonas bacteriophage F110/10
MFNTKSVHIASALEQAEKLQLLDTSVVQIRSVIQFMEALSYHFNYTTGYFETEVRAVKHISKLSFNTAVRLHNMGYVPSIKPIGHYCWQAAGAGFRTAGFIDLVVSPELMAVAQANKIVKEAKIQKDRKGNIHVQSVLVKFANEDFARRYSVLQD

SEQ ID NO: 211 - protein, 402 aa, Pseudomonas bacteriophage F110/10
MSYFQRLYGLDKKGGFKEWTVEVVGEEDGSFNIVVKYGKEHGAMTSQVTNIRVGKQKRSVEEQAVSEAQSKVSKQLDKGYRATKEELNDLPVMAMLAKPLDPAKYKEGYGSPKLDGLRCMAKKANGVVTLASRMGKPYNVPHIIKELEEIMQEGDVWDGELYVHGEVLEDINSAVKREDAYDKWMKAEKALDAYALENGEEEYDRLLKEVDSTSFIYGLRKRMEFHVFDIVKDALTFKERLVDFQFQSALHSGLGSIRFVEYVFCSTFEELKRLHDVYRQKGYEGIMWRSPEGLYESGKRSSGLQKYKEFFDMEMQIIGYVEDKNGNAVLVVFDPVPEERLEVTYGDFDARKDQIANFENYRGKWLTVQIQSRFKKTLRAQFPTGKLIRAGRVIGGVFVPEE

SEQ ID NO: 212 - protein, 138 aa, Pseudomonas bacteriophage F110/10; identical to SEQ ID NO: 170

SEQ ID NO: 213 - protein, 75 aa, Pseudomonas bacteriophage F110/10
MTEPTVMRIDDVIEALQTLRTVYGNLKVAEIEHGDPTWSYYPPSVVYLTDTDEYYMEFACPEEGYYEEIAVLIGG

SEQ ID NO: 214 - protein, 70 aa, Pseudomonas bacteriophage F110/10; identical to SEQ ID NO: 172

SEQ ID NO: 215 - protein, 89 aa, Pseudomonas bacteriophage F110/10; identical to SEQ ID NO: 173

SEQ ID NO: 216 - protein, 219 aa, Pseudomonas bacteriophage F110/10; identical to SEQ ID NO: 174

SEQ ID NO: 217 - protein, 115 aa, Pseudomonas bacteriophage F110/10; identical to SEQ ID NO: 175

SEQ ID NO: 218 - protein, 92 aa, Pseudomonas bacteriophage F110/10
VSNLVWELVWEEEYEPDNRMGLWIENPPSVDQLAEVLLGACWRLTDDKVEEAAHSLLKCGGYKVSQYHSLCLDSFFADTGLGKEVEIDLEEL

SEQ ID NO: 219 - protein, 92 aa, Pseudomonas bacteriophage F110/10
MNSVWVIFGQLWDDYSGEFDLHMLGVLGNTKAETIRRVISSYPGLPEPDEELLDCIVADLIVNAECEIDIPCGKTGKDEWVMYSIRKKEVYQ

SEQ ID NO: 220 - protein, 61 aa, Pseudomonas bacteriophage F110/10
MATRTVHYDEWDGGTEADSEEPYDVFCGTDGDFEEKNFSRYRNHITCKRCLKLLDKKKEAA

SEQ ID NO: 221 - protein, 97 aa, Pseudomonas bacteriophage F110/10
MRDEFEAWFVRNYAAQIKDGHHGFTLDRYEHPPHQYIHDTPHHDWRIWQASRAALRVELPEKMEPTRNIYGNLIIGSYNAVLDAVKEALQRAGIEVK

SEQ ID NO: 222 - protein, 61 aa, Pseudomonas bacteriophage F110/10
MFELMQELKGWAIDNSKEGVYLQKIRKEWKYVEDYIHALEELALSVMPSELLKEIQEDCGV

SEQ ID NO: 223 - protein, 182 aa, Pseudomonas bacteriophage F110/10; identical to SEQ ID NO: 181

SEQ ID NO: 224 - protein, 118 aa, Pseudomonas bacteriophage F110/10
MKFNKAQREFFKDYAIQTVKSTLMQVAAQNGLEINQEALDRAMEVVNLEPLAEAAGTAFLERVDFKTLVKVDKFVRTEEFLSVAQAGAEVGEAVSGELSTILLPFFAMLDSGQKESEE

SEQ ID NO: 225 - protein, 155 aa, Pseudomonas bacteriophage F110/10
MQVINIVEYNPIVWLRSIHAHMKEGFRVVRSIEGYPVYGTLCQVQMFRQEGVSPEIEKELDGNEVIVQEWDVFSLLMGMQNAFDQGFRIDLEDPHFANMNFALKSVKMIREGAEKQTEEKVTEEVKEAPVEEAQETEAEEKPKTRRRRTTKEKSE

SEQ ID NO: 226 - protein, 62 aa, Pseudomonas bacteriophage F110/10; identical to SEQ ID NO: 184

SEQ ID NO: 227 - protein, 107 aa, Pseudomonas bacteriophage F110/10; identical to SEQ ID NO: 185

SEQ ID NO: 228 - RNA, 71 nt, Pseudomonas bacteriophage F110/10; identical to SEQ ID NO: 186

SEQ ID NO: 229 - RNA, 73 nt, Pseudomonas bacteriophage F110/10
gcucguauaguguaauggacagcacaacggucuucuaagccguaaggucuagguucgaauccuaguaugagcg

SEQ ID NO: 230 - protein, 152 aa, Pseudomonas bacteriophage F110/10
MSAKLDRDNRPELGGSLKQCTQCKVEKPTTEFYFKGRKADRRLHSECKKCFNSRMMKRYEQRAKAIVDMKGGSCYLCGYNKCVAALEFHHMDPSQKDFEISKRWSMKDERIKAEIKKCVLLCSNCHAEVHYNEARGKIYNWTEAKVVPASGF

SEQ ID NO: 231 - RNA, 74 nt, Pseudomonas bacteriophage F110/10
uggacggaagcuaaaguggucccggcaucuggcuuuuaacccgacuauagugaguucgagucucacccguucaa

SEQ ID NO: 232 - RNA, 82 nt, Pseudomonas bacteriophage F110/10; identical to SEQ ID NO: 190

SEQ ID NO: 233 - DNA, 73 bp, Pseudomonas bacteriophage F110/10
agccggauagcucaauugguagagcacccgaccgauaatcggaugguugaagguucaaguccuucucuggcua

SEQ ID NO: 234 - RNA, 76 nt, Pseudomonas bacteriophage F110/10
ggcccauuagcucagucuggacuagagcaagccccugucuagggcaaggucgucgguucgaauccgacaugggucg

SEQ ID NO: 235 - RNA, 73 nt, Pseudomonas bacteriophage F110/10
cccgcguuggccgagagguuuaggcggcggauugcaaauccgucucacaucgguucaaauccgauacgcggcu

SEQ ID NO: 236 - RNA, 73 nt, Pseudomonas bacteriophage F110/10
ugggauguagcucaguugguagagcagggagcuguuaacucucaggucgcagguucgagcccugccgucccag

SEQ ID NO: 237 - RNA, 75 nt, Pseudomonas bacteriophage F110/10; identical to SEQ ID NO: 12

SEQ ID NO: 238 - RNA, 74 nt, Pseudomonas bacteriophage F110/10; identical to SEQ ID NO: 13

SEQ ID NO: 239 - RNA, 73 nt, Pseudomonas bacteriophage F110/10
gcgucugaagcuaacuagguagaagcgcuggguugaaauuccagaggacuuggaucguuaccaagcagaugca

SEQ ID NO: 240 - RNA, 73 nt, Pseudomonas bacteriophage F110/10; identical to SEQ ID NO: 15

SEQ ID NO: 241 - protein, 93 aa, Pseudomonas bacteriophage F110/10
MLKGQGIEPVRRERRRKPFSTGEEERVSCCGIEPPIALLREPAILALLAYDPESLKASTRYTIARHWLEAGTRTPTIGSQPKGSIRATQSPHE

SEQ ID NO: 242 - protein, 506 aa, Pseudomonas bacteriophage F110/10
MENTKVPDKKLGPIALALKEARENFDLSPHVIGPKSFKQKEFTDSDAKITVFGGAAGAGKSYLGVMDFMKYIHDPNFRGVMTRRTTPQIKGPGGLLEKATDLFKLVDPKVKWKDKDGKFVFSSGAVIFLRHFEQESDKDSFQGWEVSKFLVDEGQQFTEGMVTYLISRMRNPKCSVVPHMKITCNPDYNSFLRKWIEWWLDPDTGIPIPERSGVTRWFVRKGGKMFWGDTKEECIALHGNPSLAPDDEDQVKPISFKFIAANCFDNPILMLNDPEYVANLEALPRVEREKLLDGSWHAREEGAGYFTRDWCQIVPHPPLRVLKRVRAWDISGSIESETNRNPDWTAGVLMSRTKEGLFTVEDVVRERRLFGGVFDLILETAKQDGQDVEIQIPCDPGAAGKAYAAQLIRDLADHGFHARPKTTNKSKVTRFAPFVSVAETKSVQVVAGDWNEDYFDELERFDGSKAIKDDQVDATSDAFNALSLGSLIIPDFLPPDMTQSNKFKLN

SEQ ID NO: 243 - protein, 479 aa, Pseudomonas bacteriophage F110/10
MAETEKTAPGIPRLRLGEIGSTGLKQVNGTILEERRPELRFPRACRTFQMMAEDPTIKSALDLFEMMMSRVDWEVDLGVDPDEAMKARGKFLKECMHDMEHSWYSFIKEVTSFYTYGFSVHEMVFKRREGYPVSKYNDNKFGIKKLPIRSQSTITKWLYSEDGRNFLGCEQSLANVVNGDRYVNLGNKDGTVEIPAKKMLLFRVDAKRDSPEGNSPLRACYNAWRYRVEIEEQESVGVTRDMNGMPTLYLPPRYMSEDATEAESAVYEYYKRVIRNIQMNEQSGLILPQAFDPESRQPLFKFELTSSQGSKMYDTDAIIRRWDNKILQALFADMLKMGQDQVGSYSLAGAKTNIMAMAIESRLREIKDVLDNKLIPTLFALNGDYSPDLPKLQYGELDEIDLEEFSKGIQRIGSVGGLERDREVYNKIRKALKIKPRPDDEPVDVDNIMGGQSQAGKAGVGNGASTSAAGRDNAAANNA

SEQ ID NO: 244 - protein, 156 aa, Pseudomonas bacteriophage F110/10
MLTLESVIEALSNAFGAPAKAEEAPAVEVTKSLDNEKRMALFVVLEPQEGDSTTDLHADTYSEEEVEKACINFNTHCNVANIFHKIETQEAEIVQSFIAPSAFTTDDGREIKKGTWLQWWHFPEGSEVADTLWEGVKSGEFTGVSIGARATVEDIE

SEQ ID NO: 245 - protein, 305 aa, Pseudomonas bacteriophage F110/10
MTVKAKRKLTDIKFEHEGAHVALVSKLQGGAANGHTTLITKATNGVTEELIDKAAEVTVTMQFPEFLRKFFGMYYDDAEVLSVAMGYGRTEYPELDHKDWIDQRVESMSILKSVYKSADLNQALSELTPEQTLSLKQDQELLEKALEVVSEQSNENPSKEITNMETILKSAHLEALADAVAVEKAAGVAAVAEVQKQLDAANVELTALREIVKAAEAEKTAAITKARKEQLAEVLPADQVEDTFKSLEVLDDQAFAQTVGTLRILKAAADQNDMLVEKGVSGAGEEDDSVVAGVAAILKARHGSK

SEQ ID NO: 246 - protein, 136 aa, Pseudomonas bacteriophage F110/10
MAQNIIAKDHQRLSNWLKEEQMGHRGLFYTRETLPVADIDVKTTGSVLDSTGKLVTKATIADATYILMTDLHDYANAQMSHAVVLARGFAKIGSKAVIFGADVDDADKATVFEAFKAKNIFAVDQIEGAFENVTFA

SEQ ID NO: 247 - protein, 344 aa, Pseudomonas bacteriophage F110/10
MANTRSYLNDGQFYIADQTENLLIIPNTWTLVENMGVFTSEGVTQNTVQFEEIETRYGLVKDAIRGTRHQVASDQRRQLRAFAIPHFNQDDYITPEDIQGKRAFGADREETLNEVRARKLETIRRNWANTAEVASVSAIVTGKSYAPAGTIEYDWYDLMGKTRKVVGFDLTNPTADVMGKTEEIFVHMQDNSQDGLIRGDFVALCSPEFFTALINHPSIKEFYKAYQASPQYWRDRLTARGLDLRFREFYFGNIHFIEYRGVDPYGNRLIPAGDAYFIPTDSGDLFARYFGPGSTFDDLGTLGKELYATERMAEDRRSILIETESNFIHVLRRPQMIVRGTVNA

SEQ ID NO: 248 - protein, 158 aa, Pseudomonas bacteriophage F110/10; identical to SEQ ID NO: 22

SEQ ID NO: 249 - protein, 141 aa, Pseudomonas bacteriophage F110/10; identical to SEQ ID NO: 23

SEQ ID NO: 250 - protein, 126 aa, Pseudomonas bacteriophage F110/10; identical to SEQ ID NO: 24

SEQ ID NO: 251 - protein, 187 aa, Pseudomonas bacteriophage F110/10
MIHTELENSLYLMVKELFPDWRVIQAYTNNQEPQTPYLAIDIKRLDELGRENVSNMSDPISPSHGTIQVQQDFAAKVVFELVGKYGETASVSDMAMAITRALRTPAGHAAQRKFNLSLFKLPSTKRVPMLRETDMYMFYQVTCQFGFSVIETTTQEFAAGADIHGVYYDAGRPGHVIESHIDINFEH

SEQ ID NO: 252 - protein, 428 aa, Pseudomonas bacteriophage F110/10
MTVLTDVIDIQISRETAAVAQTNFNVPLFIASHTNFSERAKVYNSLRGVAEDFGESDPTYLAAVRYFGQALKPRSLVIGRRQVPSATVSVSVVQEGQSYVLTVNGLPVSYVSQQDDTATLIATGLKAAYDVTPVAGVTVTDNEDGTLTVASNEDWSLKVSSNLTMAAAPSTEGWPATITAVQGENDEWYALSIDSHADDDIMAVATHIEGTKKVFVGATAQANTKTSADNDIASRLVAGGFQRTALMYHPNADAQFPECAWVGYQLQEQPGSNTWTHKALAAVDAYRLTPTESTNLKNKNVTTFERVGGVNRTFGGAMAGGEWIDVMIFVDWLEARMTERLWFRMANSKKIPYDAVGATILESEIRAQLNEGIRVGGLAEAPAPKVFVPDVLSMSPNMRAQRIFEGIEFEARLAGAIHFVHIRGTVTV

SEQ ID NO: 253 - protein, 258 aa, Pseudomonas bacteriophage F110/10
MRILYLYKITNRCNDKTYIGVTFDPKRRWQQHQYESSNCVKLRRAIAKYGKDNFKFEVICSGTEEYILDLESKAVIAYDSIQEGYNTIPGGNRRGISLEEDTKAKISEGLVRYYEVNESANKGRKVASRSDDEPLCVFGFWFPNVRTAIEVLGINRKTIYSRRSNGTLHLESRPLKVESRPARGSEQDRKNRSDSMKGKNAGRSNGMYGKKNPSRAKSVSIEGVVYESITAAVRHTGYTKSQIEKRLSKGVDGFKYVP

SEQ ID NO: 254 - protein, 174 aa, Pseudomonas bacteriophage F110/10; identical to SEQ ID NO: 27

SEQ ID NO: 255 - protein, 166 aa, Pseudomonas bacteriophage F110/10
LITTYSPRDVVVTLAGIHSVTGYAEGEFIRIVKDIKPFIKHGSMDGEIARVYNKDQGWRVELTIMQSSPTNDILSMLYNVDIATRMGKFPLMIKDTKGSTSFLALTAWVEDLPRVSFSGQLETRTWILGCSEVAMNIGGNVDQSLVEQAILLGSSLLPALTQFGGF

SEQ ID NO: 256 - protein, 159 aa, Pseudomonas bacteriophage F110/10; identical to SEQ ID NO: 29

SEQ ID NO: 257 - protein, 123 aa, Pseudomonas bacteriophage F110/10; identical to SEQ ID NO: 30

SEQ ID NO: 258 - protein, 50 aa, Pseudomonas bacteriophage F110/10; identical to SEQ ID NO: 31

SEQ ID NO: 259 - protein, 788 aa, Pseudomonas bacteriophage F110/10
MITERIAQLTGELKFTVDSRPLTAFDKKLAGVEARLREFSKLTNKRFGVKLTLDTKTLREELAKAATQRVVLKNIAVDAAAVRLISEKLQERLNATPIRLKSVRLDLSGIRDQKNFVKTALGQTKVDLPVELGLAQASRTLYEWKKRTESRFKIHLNADISRSKLLQNARNTLRDVQGRLNGLAVATPQIRLSVDRAHLRREIQDVLEQIRREVRIRIDLESSIRGGGAGGSRGTAGHIRQGMGMGIGSELAGWGRGFIPGLGGAFAIMQLNRANQELQGQRLAMQAVGGGVQGGQELQATLRDISQRLGLDDRAIGSSYVKMMAAGQASNFDKTQVDGIFQSMAEYGRVMGLDGEAMKGSFRAVEQMMGKGQIMSEELKGQLAERFPAAVALMAKSQDMSIAELMKTMEKGELKSDALIPFARTLAEEARKGGALDAAMQGTAAQQGRFQFGWNRTIEAFAAGGFDRGMSDFFKIAAQGMQDALPLVTALGGGFEALMRPVNALVGIGGELGSQWEKIANQFNLTGTGLTLTTAQTLALLTPMGRLVSAISWGALALEDFIVFLEGGDSVFGDFLNNNVQAAETFEKLASESSELKNNLDGIFSVVPGLAEALKGLEFNEMLVSTMRELAAIMEFFNSVVERFAIAGKYRDAKIAEAGGDRSTIMSNIDTMYAMFNPEDAKDKATFIGDRLVAQNIDAIQTETHTRATQSLTPDQFGYMMQRGQVRNEMEGALKKSAIDISFNLNVSGIDAQGNVMTTEAQERVREIVSNVLEEEISRASASYKESQ

SEQ ID NO: 260 - protein, 253 aa, Pseudomonas bacteriophage F110/10; identical to SEQ ID NO: 33

SEQ ID NO: 261 - protein, 118 aa, Pseudomonas bacteriophage F110/10
MSTTYIDTLPLYQDRKYRYAVAIEGISRVLQFYWNSRSRQWHMDIFDEELTPILTGLAVVPQYPIMADYAMQHIGFNGYFLLMPVNLEQVQYKHDASDIVPQFFELLYVNVDLEDDVE

SEQ ID NO: 262 - protein, 305 aa, Pseudomonas bacteriophage F110/10
VKQYDRVYKLTLGNTESGQGVEITNLHPDGSLNREGLQFRFDISKSSDNKKSGNSATVEIYNLSIATLNILETEYLTCRLEVGYKEMGTSVVLDGNVVETSTRKSGNDYVTQLILGEGYTALTETKLKGTVSPGKTVKDVIEEIRLQMPGVDRGAYTGLNCNNPIMYGYQLRGLAKDALNSVCEANNIEWNISGNVLNVTDVNGPTTKSVQMAPLVNRETGLIDIPFYASASGTAQKKDKRRRRGVQFKCLLNPELTPGVLVRVESDRLSGTFRINNVRISGGYRDNEWYTECWCSDLNQEDIDQ

SEQ ID NO: 263 - protein, 246 aa, Pseudomonas bacteriophage F110/10; identical to SEQ ID NO: 36

SEQ ID NO: 264 - protein, 123 aa, Pseudomonas bacteriophage F110/10; identical to SEQ ID NO: 37

SEQ ID NO: 265 - protein, 487 aa, Pseudomonas bacteriophage F110/10; identical to SEQ ID NO: 38

SEQ ID NO: 266 - protein, 243 aa, Pseudomonas bacteriophage F110/10
MAVNQFDREDYLEVARERVTEQFKEKPIFDRFLQVLLSGKFDIQNALEDLQTLRSLDTATGKQLDIIGDIVGRPRGLVYQDIFNYFGFAGTERAGSFGSLSDPTVGAPWYSVGAPTGNAREPSDEEYRMILKAKIIKNRTNSTPEQVIEAYKFVFGVPEVFLEEYAPAAVRIGIGKILTNVECSLLFDLGGAGALLPKTIGVNYTYTEFQAGRVFATEGFPGGQGVGDLNDPTVGGILTNLVT

SEQ ID NO: 267 - protein, 670 aa, Pseudomonas bacteriophage F110/10
MADIGQLPIENIWSTGGDMVAPTPAQQQGGWGIQSVPRQWWNWKWNLHDTNLAYLLQKGIPEWTSTQEYIANKSFCTRGGFVYKAVRTHTGSDPATANPNWARAFADFTTSSSALGSLTPRDGGIPFFISATGASVFDSTAYGRGMLNVANAAAARNYISAQESSVVLSNLSTVTRAANTVPYFNTDTSMATFNITAFGRGLVNAANAENARNFLGLANSAIITADPANRAHTLVYRDAAGNFNAGVITATLSGNATTANKLRTPVTINGVAFDGSQNIVLPGLDTSYAGTVARLHINGANLSSADKTTQLALRNKSDNDWISLAVVDDNILQFVFRSATNPVVQIGNEVILHTGNQFSLGPTLTDARSRLGLDRLTQGSSDTQVFPSTLNNGPYLTVQPTAIGGFNGSTNGWLFRFDANGNMTHGTVPAARITGLSNSAQIPATTTAQANSLVQRDADGGFSAISINAYGTIVGYGSNIFSRASGTGNAHIGFQRANGTELGLIWGAQSNNSMNFRVAGGSTAVSITGLDMTVTGRVNATTLNASGNVNATGNVNAGSATLNTAGNITGAAYGAYGSLTNWVDSVYAKKGEIPNDIARAGAAWDAVGQYILAGDQSGGSGGPGTIRAGNQLRPYSTISYTAGSLPAGSYRCMGAFAAGGNQITLWQRIS

SEQ ID NO: 268 - protein, 125 aa, Pseudomonas bacteriophage F110/10
VEFRNVVKYKMGYECEVNHPDFGWIPYFACDYDDTAKVVYDSIVKAIDDGVIPEPEDVSDRDLEFEARVWRNNELTLADRQVEIAIDDEDEVREKAWRKYRSALRKWPEHKNFPSEKSKPKAPKE

SEQ ID NO: 269 - protein, 499 aa, Pseudomonas bacteriophage F110/10
MPNIMKPTGINAIWSENGQKVDPGAVKVGLGWVTELPPYQTANFIEYKQDLFNAHVNQHGIPEWDSVTEYQGNLSYTQGANGIIYKCLRTHSDKIPTDPLNITAGYWRVAFEDAGEAAKVQANLDRHVTNYNTLSGIGNVVIARQNLSVYSKAEGDARYAMRHGNGSNVFSVAPATQPTHAIPLSQLSTLVPPATETVAGVMAVATTIETEAGANDAKAVSPLKAAQVYLKKKDNLSGLSNVTAARANLGLSDTATMPSSTFLKAGSNLADVPNKALARSNLGITSSATQPETYFLRSAQNLADVPNKAQARVNLGLTGMATTDPAAVMMKADNLAGLANTATARSNLGLGTASTRNTGDFLSSGDNLSDLTNVQAARNNLGLKGAATLDVWGLPANTTAMDFQSNQSDISRGWARLPNGLLLQWGTGPGLSDDTRTNIQLPVPARILNVQVTVMGTFNNSIGPGAFMTDMWSNTGFRVSCNWGNWSYPFNWFAITSTL

SEQ ID NO: 270 - protein, 186 aa, Pseudomonas bacteriophage F110/10; identical to SEQ ID NO: 43

SEQ ID NO: 271 - protein, 79 aa, Pseudomonas bacteriophage F110/10
MKKLFKSWKFWAAVGSATFMALEAMVHLWEPILPPGVFAAVATLVAVGVRISAVFVTASKVEEAISETIEDDTIENDTN

SEQ ID NO: 272 - protein, 147 aa, Pseudomonas bacteriophage F110/10
MILTKLKNYALVVAAAMAAGFGYLSFSLYGDLAVAKNDIQSLEAASRQMEEQFQKERAGCEITTGRLEAHIAQMKSRQELLQGHLCELESLPNPTPRETQENATETISEPSTGDSLDPALTSLLDRAFCSAVPNDPYCAPGKPDRGG

SEQ ID NO: 273 - protein, 43 aa, Pseudomonas bacteriophage F110/10; identical to SEQ ID NO: 46

SEQ ID NO: 274 - protein, 101 aa, Pseudomonas bacteriophage F110/10; identical to SEQ ID NO: 47

SEQ ID NO: 275 - protein, 104 aa, Pseudomonas bacteriophage F110/10; identical to SEQ ID NO: 48

SEQ ID NO: 276 - protein, 102 aa, Pseudomonas bacteriophage F110/10; identical to SEQ ID NO: 49

SEQ ID NO: 277 - protein, 106 aa, Pseudomonas bacteriophage F110/10
MSLQYVVRGDQHIDEDATYQLSYPDLKATYERLSKLDDSSFKASMPEVLHFCCFVAWIKEIPSSLLLGDRGLIHLIAHHIHEGAEDDGPQAFKSLRHQFNTLMKLD

SEQ ID NO: 278 - protein, 270 aa, Pseudomonas bacteriophage F110/10
MSRVKDHIEEAHRPASRETTHLGSFVYSQGIGGDKVPAFVIAMENQEQEERDNLALLLYFSDNHVGWRSWGDVGSTSLRIDPKLIDKRYWDGDYGTEVIDKICGQSCFSYIDEQELIKKFHDTWMEWPFHTAIVEDQEPTFGELFERESVFEFVSGFNKMMTGLEVVNRKWNTDLVTGEPIKRDALHMLMLVTTEIAEAAEGVRKDLMDDHLPERKMEEVELADAIIRIMDYANVRELDVAGAIIEKIEYNMTRADHKREARLAEGGKKV

SEQ ID NO: 279 - protein, 51 aa, Pseudomonas bacteriophage F110/10
MAYWGCGEVDRVVCECCGNNFPPEEVVSDDGMLTCVDCYFEMFCEEGEVNE

SEQ ID NO: 280 - protein, 378 aa, Pseudomonas bacteriophage F110/10
MSNSQDRVLARVVRIDDVKTHPNADSLDLALVGGWQCVIKRGEYQAGDLAIYIEVDSMVPVDNPIFEFLRGRNMVERDGKEYSRIKTMKLRKELSQGLIVPVHSAGSPEPKVDEDVTDRMGILKYVKPSEQAAINGGNKGDRTGTSKLGFPNFIPKTDQARVQNIQMAYDQAHQKGEKFEVTFKLDGSSLTIWHKDGEVGVASRNVGFRLEDEKIGFFAAVKNFFKGLGWKRVIKKDSNHFTAMAEELDLGKRLREFGLNIALQGELVAPNIQGNFEGVDKPEYYVYDIYNISDSRYCLPAERLAILNTLNQLGGETVKHVPVYMWDVGVPKDMQLVIKMASGESALNGKYREGLVFKSMSRDFSFKVISNEYLLKEE

SEQ ID NO: 281 - protein, 77 aa, Pseudomonas bacteriophage F110/10; identical to SEQ ID NO: 54

SEQ ID NO: 282 - protein, 47 aa, Pseudomonas bacteriophage F110/10
VSDVDISLQQVTHFTTDYFLVKAIDTAEESVQNTTTFNTTGEKHNED

SEQ ID NO: 283 - protein, 65 aa, Pseudomonas bacteriophage F110/10; identical to SEQ ID NO: 56

SEQ ID NO: 284 - protein, 161 aa, Pseudomonas bacteriophage F110/10; identical to SEQ ID NO: 57

SEQ ID NO: 285 - protein, 84 aa, Pseudomonas bacteriophage F110/10
MEIISRGTLPQEALFTAKCHHCLSILRAKRSELEYVSFSFCRPGETGYYFAECPVCHEEVSAWVAAPVIPVAPATTEYITKERK

SEQ ID NO: 286 - protein, 129 aa, Pseudomonas bacteriophage F110/10
MDQLAGFMGEPFVIAFDYDETISLYPLAFHIVMDTFRGFGGAFNVIVVTARHPDNSGELEWLRDYGFPIYFTAQKAKRPFMENLGIKVSVWVDDNPFSVDNDLPPWTVEQYDAYMEAKKQRAINRGSKA

SEQ ID NO: 287 - protein, 221 aa, Pseudomonas bacteriophage F110/10
MSEIMKVEVGDRVVLKAYCDTYTGCAKRWAQAHGRLDELLATGFVEDSWVHCDDLAGGLKGTVVMTELGLKEECCAVRLDAYTDNRAVVVVDASDLYIACKAAKAPVSTLDEAFGCDHDYLMDSPANAQRLNESVEQLRTGQVVEVDVPMSVKQDETPPVVVHVVEKIYDRKGNVHLILQYEVAGALIRTVVEQGELIYFLDEMQGMYLTKIQLEVNDGVV

SEQ ID NO: 288 - protein, 54 aa, Pseudomonas bacteriophage F110/10
MELYDQWRKYISVVILEEEDNERQCMRLIEAVGELDPYIQDFLDSLSIKTEGGV

SEQ ID NO: 289 - protein, 100 aa, Pseudomonas bacteriophage F110/10
MSQSKRDEIVVEARGLESYFISHWNGWDVMDTACLGFYIKPEYVLDPDIRELEPSFLELDFERCRFRFWGNEDEGVDGKLMEGKLQIMTNSFEYVFFKEV

SEQ ID NO: 290 - protein, 140 aa, Pseudomonas bacteriophage F110/10
VARQTYESASDRAVEEAVRSELEGRWKCSLHKLPRAHYMDWAACRNGKVVSFVELKARNNEMQKYPDFFVSQMKWLHGIEMQRVFDIPAFLVVKWTDYTGYVKMTANGVNYMSMGGRIDRGDWQDQEVMVHIPLKDFTRL

SEQ ID NO: 291 - protein, 42 aa, Pseudomonas bacteriophage F110/10
MAKKNPVFKFLNTVNKPSVERDKTKYRRKPKHKKKERLNEEG

SEQ ID NO: 292 - protein, 63 aa, Pseudomonas bacteriophage F110/10; identical to SEQ ID NO: 65

SEQ ID NO: 293 - protein, 81 aa, Pseudomonas bacteriophage F110/10
MNGPECRWCGEKTEAEFVDVGLGWMQQVTGGMCHQCGGYENGHYQNDGRLSEVEFATYWSGPFEDYADFSPFNHMREGDSP

SEQ ID NO: 294 - protein, 61 aa, Pseudomonas bacteriophage F110/10
MKATLRNHNLLYIYFHTFSEMNEWLTENAVDQWTVTTLGSGYQVAVPMDRAMRDQYVSERG

SEQ ID NO: 295 - protein, 620 aa, Pseudomonas bacteriophage F110/10
MSKMTVAQIAAMHGIDLYSDHKTACPQCRKKGADNSGDNLKVYGTDRNTGEHKGAYCWACGYTLLSEEQERDARGEDEEEWNFVGTEFNAEINAQIKEQCSYDPRGYRGLSKETCQYFGVLHGFDPETGEIATQLYPTTTNYELTGYKQRIMPKNFSEPIGETGKDCELFGQFRFKNSNSKKVLIVGGEVDQLSAFQMLKEYDDRRAGGKSDYEPTPVVSPTIGESGAWKQLQAQYEWLDRFEQIILCFDSDDAGREAADKAADKLPKGKVFMMEMNRKDPNEYLKAGRQSEFVSAFYRARTWTPSGIVGSDALDARMYEAVQVEKIPLPPFAKKLQKAMAGGIPLGRIVNIGAASGMGKSTVVDEFTLFWIYNSPHMPGTVTLESDCGEYAIKLLSRKVGEKADLYETVEEKVAFLDRHRDARYDLWHKEDGSPRFYLIDDRDGSLAALKAQIEQLIIQFECRVIILDPLQDILDGLSNEEQSVFMRWQKGMTKSHRVTFININHVRKSGGGQKANSAGAELYEEDFQGSSSIFKSGAANILMWRNKDAENEFEKNLINVKLSKCRWTGRTGMMGNWYYDVETHTIWDLDDYLDRYPDKRREYEAWMAQKEEEGRDTEY

SEQ ID NO: 296 - protein, 904 aa, Pseudomonas bacteriophage F110/10
MQQRFETIEQYLEWMGNNNVTNMTWDIEATGLLDETSIDYTASPYKIKPSYKHHCIVVEEHGGNILAFYDGPTYVFDGREYTERLPKASSMLHTEEVVTLKDYTPVEYIHLPLKEFKNYVAKRRIKRVVAHNMINFDLMSMKLVEDMDFTIGVEHRDGGLTTWSADTWMGKQVVFDDTLVISKTCNPDLFGGHSLDKLSRRAGGDTKIDFRKHLAPDVRFLDFAADMLYYCIYDVKANTAVWHWLQDHEDYQLSDRDNYIKNWLSPIQLEKKVAEIITYQEHRGFVLNVDLCEKAVKDLDAKMEERRARVEPVLPPRPATKKFMADYTPPVRQFKKNGEITTYLQKFIEKIGAQLKEGDDRTMIFEGKEYKLPLPADVPLKTEMPAKIGDTTHIKQWLMGEFGWIPSEWKETDLTVDQKKIKLPMENIVAKIDRWLDVTYSTAYKEERLDGFGDYMKITPRSTRAYVRQRLIDRASKGGCKVLTNPSFTKGQEKEMCPDLERIAEQFPFAKDVIEYLTFKHRRSAILGGGMDWDEMEEGEEPEKGYLASIRQDGRIPTPADTCGAATSRMKHRKVANVPRITSLYGAELRELFGVGDGFFQIGYDFDSLEARKESAYCDQYDPTKEYCKSLMMEKPFDVHTMMAKRISEIIGRQFNRSPAKNVKYGCTYGAQAGKVAKTIGADLQTGQLVFDAFWDAAFPLKALKDDLTKQWEANGKKYIVGVDGRRVPTRSAHAILNSLFQSGGVICAKRAMVIHDQLLEKEGLKVDFFKEDWKNKPEFCQQMIAYHDEAQLEVTAKSVSFKMFPWSLVGGKPEGEKEREAAEKELKALAQAYKDEQLASTGKVWSDIAHYSKGEGGVFVAYCRAGELATKAVRAAGEFYSTPLVPIELTAGYIVGRSWKDCH

SEQ ID NO: 297 - protein, 132 aa, Pseudomonas bacteriophage F110/10
MTLAFVIYLVMTVFPALSAAGHFTLIVTILAWVAGGFVYLASIGGRENASVKATLKNHLRPLTFKLFLPIIVIGHLVPSSETAWWMVGGYAAQSLYQADATQQVLSESTELLEALVKRAKKETLKAVEGSSE

SEQ ID NO: 298 - protein, 55 aa, Pseudomonas bacteriophage F110/10; identical to SEQ ID NO: 73

SEQ ID NO: 299 - protein, 236 aa, Pseudomonas bacteriophage F110/10
MSGVIPGTIVKLTQVGCDVTVGWPKEARYVGAYAVAVDGRDIGLPEGEIRFCSLHWSIDRDVNDGLGDYQSMLADNDRFEIVAIPGKKYYVKSAAERPDLISHYLVTSEPALYEGFEPCWLKSMLEGESPFCMLFKGRVNIGGDISDDPKLQTLYPELVLEEFKEEAEEAIEAPVNEEKKEKVAKPAVMGYAVLDVDGFPLKFTITREEARSTKRWWGGKAEGVSIVKLIKGEEVR

SEQ ID NO: 300 - protein, 334 aa, Pseudomonas bacteriophage F110/10; identical to SEQ ID NO: 75

SEQ ID NO: 301 - protein, 83 aa, Pseudomonas bacteriophage F110/10
MQINFGPIFLLAAIVLCVLKSAGVLAISWTVALMPIWIPLVIVLSVLLLLLVVAGLIYAFGDRSQLNFAFKKNYSLKKNFRNK

SEQ ID NO: 302 - protein, 74 aa, Pseudomonas bacteriophage F110/10
MMSNLVIVRVPEYILKGPAVQNQFSGEVWERELFKDLKEAAKSIIEGEPAYVALPNKVNPDTRQTEWDIKVVQF

SEQ ID NO: 303 - protein, 350 aa, Pseudomonas bacteriophage F110/10
MSEKEEDIVLIDGDLIAFKCASVNETRSIIVKNKLTGEEETWKNRTTWRENNKDEEGFNEDNFEIEDHQDPKHVSYGISVVKTMIDRICRQAGCKQFKILLSGPDNFRDAIPLPKEYEITKGKKTFTRGGRYKGKRTGQIKPLQLGQLRQYMIEAYDTIIHPGEADDLMAEMMYKNGVSYSRGETTQRVIGATIDKDADGTLGWLCNYEREPVQVKFISGLGSLYRDSKGKVRGEGRKFFYFQLLFGDPVDCYRPADLCIGKDFGEVAAYNIINPCATDKECWQAIYDTYKAWYPEPVTYTAWDDTEHTKDAVEIMQMYCDCAHMQRWAGDRVDCRAVLAKLGVDMGGAE

SEQ ID NO: 304 - protein, 187 aa, Pseudomonas bacteriophage F110/10
MSVRPRPWEDFPGIWKTEAAFLSWVRGGIRRYLWSKNPVKLEFAKSRRIKIANTNEKSKLRNPTVWGYVCEQCGKETPQANVEIDHKTGEFSLKRVEDIQSFVEGVVFVRMEDLAVLCKPCHEIKTYAERYGLTLEEADIVKQAIAIQKRKGYDKVFLQEVGIKPASNAELRKEQIIEYLRSKKEGG

SEQ ID NO: 305 - protein, 132 aa, Pseudomonas bacteriophage F110/10; identical to SEQ ID NO: 80

SEQ ID NO: 306 - protein, 76 aa, Pseudomonas bacteriophage F110/10
VREEFIKIMRKLPIRVRASIVLIWIALFFWLPVVTALVAGVIDFFYTAKDQLEEGYSVLISAAKGAVKCLRTGEEL

SEQ ID NO: 307 - protein, 145 aa, Pseudomonas bacteriophage F110/10
MTSLATYVIRHKKTKELWTTPKGKRQWATKGAAALAWRNAYEGTTLGVWAAKRDMERWSDLNIPMIVENGCYRLASREAAAFKSQSAFEIIDIAESLKNENQLVLDLLKDVIGFEVPDSVGDGYVRLAIKTSTYDDIIKLLKETK

SEQ ID NO: 308 - protein, 56 aa, Pseudomonas bacteriophage F110/10
MSMMDPKAYFIKQDLEEATKLLERAHNLLDNVHCYDTDVYEDIAAFLYGRDCEEAE

SEQ ID NO: 309 - protein, 83 aa, Pseudomonas bacteriophage F110/10
MIQMYMRILQRSFTVETARRQSKVQKDIRKTTSELRDLCEAVSMLDEALVMMQKNGLYDTDLYKRIDAFLYYQPGEGEWEVLE

SEQ ID NO: 310 - protein, 259 aa, Pseudomonas bacteriophage F110/10
MSSKKHFVISDTQCKPGISLDYMEAIGKYIVAKRPDVVIHIGDHFDLASLSSYDKGKRSSEGRRYSEDVQVGREGLDRLFKPLWELQERQRANRKKVYQPRLIFTLGNHEERADRAANDNPELYGTVGSDELGIQDYGFEVVPFLKPIEVDGIYYVHYLQNHFTGKPLGGTANNMLKAAGHSFVMGHRQLLDWAIHPTIDGKQRLGIVTGACYPHDEAYKGYQGNNHFRGCVMIHEVKDGFGLPMPVSLDFMMEKGGFK

SEQ ID NO: 311 - protein, 60 aa, Pseudomonas bacteriophage F110/10; identical to SEQ ID NO: 86

SEQ ID NO: 312 - protein, 69 aa, Pseudomonas bacteriophage F110/10; identical to SEQ ID NO: 87

SEQ ID NO: 313 - protein, 111 aa, Pseudomonas bacteriophage F110/10; identical to SEQ ID NO: 88

SEQ ID NO: 314 - protein, 69 aa, Pseudomonas bacteriophage F110/10
VEEIVKEDLSGDDLMVDSAGLDALLAFLESQFKGPKGVLKGYVTMRVMCAKIESLDGFQELKDMEVNFE

SEQ ID NO: 315 - protein, 316 aa, Pseudomonas bacteriophage F110/10
LSNDIIDVHAGQPISLVQRSKNPINIQYWDADTIPYGTVLVVTEERGDIRKGELVVRLASSADDEHSVRVCRFSDFFLLMERGYDAASLGDVKQAYDVLFEDHPVTTFVNWDRAQPLTNSERYYGDFLIGGDPKGMPLFNMAVLKNVLSPYTADDEELSAMTGNPETVEHKEVDELSERDEALAEVDRLNEELVALGKKVVFANLEDYLGKENYATLEAMANHKEAVGSGGSSSYYTVKVNNPTTKANMPYFAECNDIIEALDMRFGQGNMFKALWRAAAAQNLGKLKAGNDVIRDYEKVIFFAQLEIDKILRERG

SEQ ID NO: 316 - protein, 321 aa, Pseudomonas bacteriophage F110/10
MQISAKVIQHSYRIGSGTKNHRFITTFELEYPRFIHSELMTHRLFSRNAASSRAIPVAHMIRQVEENPAMPVHWGMNQPGMQAEFELSECLQRSSQYLWKKAAKSAARIAIALNKMGLHKQVVNRLLEPFQMMKTVVTATELDNFFYLRCHKDAQPEIKVLAEKMYEALLKAGPAEALYDGEWHVPYVTRFRIGDGKLRYADCNGQELSVEEAIKVSASCCAQVSYRKNDETLEKALVIYNRLVDTKPVHASPFEHQAKPMLEPHFWCGDCQQQPDWEDGVTHADREGNFWSGNFKGFIQHRQLIEGHVCNEFYGPEKEGV

SEQ ID NO: 317 - protein, 114 aa, Pseudomonas bacteriophage F110/10; identical to SEQ ID NO: 92

SEQ ID NO: 318 - protein, 350 aa, Pseudomonas bacteriophage F110/10
VGMEVTKALVDEADIFNKITQIRTPTESYARKYPVIVELANQQLEEKLWFSSEMKVELDKLNLKFKLEPHQLHAVKTVLQLFLKYELIVGEEFWMGKVVRTFPRPEVKLAASILCMMELAVHAEFYNQINVVLGMDTDADYVAYKDDPELMGRMDWLESVLGDEDDVLSVIIFSLTETALLFSSFAILKSFQCNGYNDIPVIARGANQSAVDEDLHGVVSAEIINQYYAEIGRPLSEDTRRVEKIRQAIDHVYAHECRIVDMAIPGGELNGESAENYKAFVRYRLNVWCRRLGLEDHFENDDTPIKDWFEMNTYAYKMIDFFTPGMGMEYELGWDEEELAKAWEEELKYE

SEQ ID NO: 319 - protein, 581 aa, Pseudomonas bacteriophage F110/10
MSKRDTFNYSEARKNSQAAGETPLWYTTAGYQLFMKKYSNEGESVRSRFQSVARAMAQHAPMVYPEWWSQDEYTKGKNWEQVFFDVMWDGFVSPSTPLLSNGGLRKKGTTVSCAGGLMDNNLYDRYNVMTEIAVLTKHSHGTSFSLTNWPAEGDAIRGGESQGVMPVIRDVINVMEEVAQGSRRGSCAYSINPRHGDFWNVIDHLYKRTESNNVGWLLDDQWCKDMAEKDPETLKRWKRMMFVKLARGKGYFTFIDKMNRHLAEPFKRAGLRCEASNLCQETVLPANDWYTFSCVILNYNLELYRSWPKHLVFIGQVMSDCNISEYLATMDEVSVQDRRALEKIYRFTKDFRALGSGVLGFHTLLQRERFPVGSMDAMFLNNAIFKGMKEQAEACNSWLAKVLGEPTGCRGLGKRNATTMMMPPTKSTAELMAGASEGIGLDVAMCFTKQSAGGEFFRVNKVLLEIIQERGLDWEECARQINERKGSVQHVDWLTDHEKAVFRTAFEVRMEDYLRLCSQRQKYIDQGQSINLYFTSNDSPAYISYIHRLAMEDPNILSLYYIYSMRGAGDISRTEECEMCM

SEQ ID NO: 320 - protein, 48 aa, Pseudomonas bacteriophage F110/10; identical to SEQ ID NO: 95

SEQ ID NO: 321 - protein, 76 aa, Pseudomonas bacteriophage F110/10
MNNKLRKEFDKWWKQDEQEELRKSCAKGWAEYIWMASRSKVKVKLPKPEGELFTNIQMHTISRCKAAIHETGLEAF

SEQ ID NO: 322 - protein, 77 aa, Pseudomonas bacteriophage F110/10
MKQHFKKRLMQTSEPFDSATQAMDVAIAWGGAKYCEFTCVTADNRVISIWEYNDVEPDKPVFNGQQRILVPTFEEVV

SEQ ID NO: 323 - protein, 78 aa, Pseudomonas bacteriophage F110/10
MEQTIDKSRYIVLDNEGRHVLTLCEKAAYNLLKGVQWTKDKHGQIHVNGVTGVELGVRQGIIAEVFLYPGYIILEEVD

SEQ ID NO: 324 - protein, 104 aa, Pseudomonas bacteriophage F110/10
MDMFDKYMQVMYDRDAFSRRVGELEKEVAELKAKVAIAKCDMRVVKTLLEDIQWVYQDEAIYTLPGYVCPCCGESANYGHFQGSFDKSPCLLACVLSRSEAYEA

SEQ ID NO: 325 - protein, 61 aa, Pseudomonas bacteriophage F110/10
MKPNVVDSLGINMCYACGGKLYVRGVCTIYCPDCEKATKDKPFVRMQLLQDIEDSKRVDNE

SEQ ID NO: 326 - protein, 91 aa, Pseudomonas bacteriophage F110/10
MATSDRGGAMATTEKIIEYVSACIERLQEDVTGYSENFRDRALSNRTGYIHGLITMAEMNQQVSIEDCDKLRVKLREAAEAVLNVLDSKIN

SEQ ID NO: 327 - protein, 161 aa, Pseudomonas bacteriophage F110/10
MNMKEIVQALIVVVALTLAAIGFVVGITALANKSAPAEDIVVSTEDGTINLGRSVKSEKLLYSMCIKVEDRKPACEFTTKDRVLSEVKQVMRPGEATARDIKIAVNAAVTYTGENGQEATSLITPKGRYLPAGTPSEVHIQAIANLFDSVYNDYKQNFSKM

SEQ ID NO: 328 - protein, 64 aa, Pseudomonas bacteriophage F110/10
MKAQPKEVETLSLDKRPKAGDVVRLRSDGKTYEVNAVYPTAVGWEAILRNMYDKTKTVTVSMEW

SEQ ID NO: 329 - protein, 79 aa, Pseudomonas bacteriophage F110/10
MARTGKCVNFLPVTPDGRVIVRFGKKRLGWLGKQGKKWHYYPYGCEGKIKSEGFKTLAEIKAWIRDPDAVWPGPKPEID

SEQ ID NO: 330 - protein, 83 aa, Pseudomonas bacteriophage F110/10; identical to SEQ ID NO: 105

SEQ ID NO: 331 - protein, 328 aa, Pseudomonas bacteriophage F110/10
MQFNISKQLWVAKSERKGDYKGTLLAYMSQVDFNKDGSLAASFKKKQQTGMGWAGKNAETCFVDNIPVSGHFIGDSVERWVTENKYFRVTDPRGFVLEVPTGNISTLLYNCTVIKGVIQEPCVWVRMGSQHVLLPEGSSIYKEAVSFVERKESAKTVKDMVAGDRCTLLSCGTENKTEAVYLGQVKLSWHLLAKKGRYSSRGWGAGRWGYHHLERELDRKEFTEKDSKWVSVFAKKLGNQWSIDFVLSPKATDIQSGSVPDELQNLDLVDGVRWKYDPLDDRPSSYYSVPERVVKCISVDDPLWDNLHHYAEVRWTREWTVVGAEWRK

SEQ ID NO: 332 - protein, 57 aa, Pseudomonas bacteriophage F110/10
MGEDKMGADSYWELAIKQVAHGMNIAERERQILIADLISWYERRILHRVKREEYEAI

SEQ ID NO: 333 - protein, 57 aa, Pseudomonas bacteriophage F110/10
MAQSLQLQLACQLKSQAPSVFISGARPPACVARLPVIIHKQEKKASENIEKNLHKTG

SEQ ID NO: 334 - protein, 158 aa, Pseudomonas bacteriophage F110/10
MLHSEARAMALQEMDKWSLLEQGWKFSFNRRMKRTLGRCNHAKKLIELGYSYVAANGVPAVLDTIRHEIAHAKAGPGHGHDSVWKEWCGLIGAKPEQYASTKEKVVTFPLRLAIRHEDGTLEPLNHFGFRRTNMARKQVRGRPETLGRLIWVKNENKG

SEQ ID NO: 335 - protein, 89 aa, Pseudomonas bacteriophage F110/10
MKALCNHRALYAAYNRSELDRIAVDLNRYFPIEKDDEWEDGAYMYRRRTYLVKHSKGTARWHSLYCNGTVQGVGVIFDVKSDTRSFRTA

SEQ ID NO: 336 - protein, 47 aa, Pseudomonas bacteriophage F110/10
MQAWDVYQNGQLIDTVFFDIMCDAEEVRKSLVNHDGYPSDITVEEAE

SEQ ID NO: 337 - protein, 95 aa, Pseudomonas bacteriophage F110/10
MDNLSVKIVLSELSYKALIQAFALLGRTLDLDEGLDDILNLIADEIAFRDGLPPFADDCDKTEWMLRRWESLPVVSYNIGQDGPIVARSIEVKTA

SEQ ID NO: 338 - protein, 82 aa, Pseudomonas bacteriophage F110/10
MRGELMTVRVGDIVAIRGDIRKKLDGTCQYTHEQLVGGKFLKHAGTGEIWTGRVSKIQGDMAKVGGAWRGIEFYVPVDEINA

SEQ ID NO: 339 - protein, 42 aa, Pseudomonas bacteriophage F110/10
MQMFFKTRTQARAMATNGRKVVDNGAQAEKRWAVKLNKKEAK

SEQ ID NO: 340 - protein, 102 aa, Pseudomonas bacteriophage F110/10
MAKSVSVDRKRSILDEAKDGSFFSVEFVKADGTVRKMTCKRQIKSAYANGQYATRKPTSAGKPHLYTAAEVLNMEEGKSAFRTINLETLTRAKVNGIEYKFD

SEQ ID NO: 341 - protein, 48 aa, Pseudomonas bacteriophage F110/10
MARSIKASDFDSAYQFEAAKRSERKESRKSRDNRKASRGRAFDFSSDM

SEQ ID NO: 342 - protein, 127 aa, Pseudomonas bacteriophage F110/10
MARRQRLPSWVQDQTEDETPLRDRIDPYLSKLGEVDKLEGQLRRVRDATDPDEYNEMAKVLKARRRKIMKQRARAYGLPEDEPTNVQGYSVPEEVHRRAILLSSVKPWMFWTILSFSIFVWFVLKNS

SEQ ID NO: 343 - protein, 223 aa, Pseudomonas bacteriophage F110/10
MHFVLNLVSKNSKTGPMPVSTSHNGTCPDACPLKAKGCYAAYGPTAIHWKKLSKGERGVEWKEFLKQVRSISRGDLWRHNQAGDLVGQDDVIDGIALMELVKANKGRRGFTYTHYPMNNFMNRQHVLSANRSGFTINLSGNNVAHADELADLNIAPVVTILPMDAENVSFTPKGRKVVACPAEKSDKVTCKSCGLCQVADREYIIGFRAHGTAKKTVDLIAKG

SEQ ID NO: 344 - protein, 112 aa, Pseudomonas bacteriophage F110/10
MDESVYAPFNQCKMMGLERTVRSLAAPNGCKVVLYQDHKNKHRIVIYDALGQGMSGVMVQADGEIHYKETRKASQGQNLTRQLQAQLTAWGVKWFPSQYQTAAGAACYKGGE

SEQ ID NO: 345 - protein, 117 aa, Pseudomonas bacteriophage F110/10
MRQLNKSQLKALGPKIDLALELASTGRGGLMNGHGSTCYIANKAGHNILRVSYHNSRFVAYGAESVRVTGNVIAAWVEWKGINRAAINALSEYGYHPNLSIGHNDALKTLRDIERYQ

SEQ ID NO: 346 - protein, 64 aa, Pseudomonas bacteriophage F110/10
VTASYSTEKRGQRWAIIRTEPGYRGDRVTVLGFCINQTHALKTVAKFRAWQALGWPYTLKDDRK

SEQ ID NO: 347 - protein, 206 aa, Pseudomonas bacteriophage F110/10
MLDSLGHSRRMALKQDKPPIGKTTNPETHFTMNKPMNTFAYAHYIARMDKASGTSLPYATLFRIALRNAYRKPGVRQYDCAALVEDIKARELVQKRIRAEKAVVMAAVMRAIRTGFTVSVKDGSDGEWVVKKSTDIKEISDSLQSTDEDIIRFRKGDGPDNIVGSMWAIYGNSAGEVIADWTDNATMAMIMAPAERKMEKYAEIGI

SEQ ID NO: 348 - protein, 70 aa, Pseudomonas bacteriophage F110/10
MSQIKIQEYIVAEIKVNHCAHLRKGQTIQARDARSSEKWIAFMVERGYSASEAAILFKDAHDVAMLELAA

SEQ ID NO: 349 - protein, 56 aa, Pseudomonas bacteriophage F110/10
MKRQYTDSYQCKAIDGLMSICGGKKAIVQVWPSLKASRNRRLKKMVKYIARSGWKP

SEQ ID NO: 350 - protein, 150 aa, Pseudomonas bacteriophage F110/10
MNTLIIRLDSAYSIQTVRSFLMEAVESIRKHIRDYAVHDEYDSGLSPVAPNHRLAIVTLDEDCRVFHIQCESPDLYLANPRIVFTDVESPAYTTPVNEIEEYSYMTAWQHIRQKDMTAKDYLSDWAILFASKENAIDIDPRPNLKTQILH

SEQ ID NO: 351 - protein, 76 aa, Pseudomonas bacteriophage F110/10
MKLRTIFETYDCRVRFVTITGVFVESQIVRSFGQAQEIVSLLCNPADTGIRLSFFDEEEGCESILCRFNYKGEIIK

SEQ ID NO: 352 - protein, 96 aa, Pseudomonas bacteriophage F110/10
MNNKYKDNIIAEYCHFDGRRPVLSLAARWVHHDSRVVKLASLFACAGYGRPYKDCIRAYKDAKQREKDMRNPAKWKLSRATKRALRARQAAKQKLK

SEQ ID NO: 353 - protein, 64 aa, Pseudomonas bacteriophage F110/10; identical to SEQ ID NO: 135

SEQ ID NO: 354 - protein, 43 aa, Pseudomonas bacteriophage F110/10
MAADALSFIVEIADALGPRMARELIPTMFRQEHQAEGCTAFVL

SEQ ID NO: 355 - protein, 200 aa, Pseudomonas bacteriophage F110/10
MTSNNHAKIHIHYAKQIYYAMRKRAIASDEICKEWAKPKTGFEAFYDWVVNVSGYAVGYRLDRNILYPGNKLYAPHTCEFTPTYMHTLFTNCDKTSNNRANTWDSYIPLGVRLARYDKYGMPVYVAQCRTLGKQSTLGSFDDPMQAHAAWQHAKVAAIHECIDLYQMEDVHSVNVVQALLERVDQLGKDIAQGKETTLLQ

SEQ ID NO: 356 - protein, 49 aa, Pseudomonas bacteriophage F110/10
MEDNIQAPLAASADGKFATVYEAIVALGVEGAAAVYRVGVGNRLTTARP

SEQ ID NO: 357 - protein, 88 aa, Pseudomonas bacteriophage F110/10
MSEQYWYPSPIGCIKSLYAVALEAWARDFWNEGNLSKILRHNGFSPCQSMEKVLQYMDQINEEYCNLMMNYATREYMEEQRQLESLHT

SEQ ID NO: 358 - protein, 136 aa, Pseudomonas bacteriophage F110/10
MKTKEIDVSNFTAEQFDAFLEYCQYAQLKVGEGVVDKIREWMEHPISVDGPDDSPRCLYIRDHSEDRFISYGTGLRSKWQPDVYALYRPTFQTKCVMTLGKADKYVVVGDETISLEELKTILAKQGVFAAFGGSNV

SEQ ID NO: 359 - protein, 140 aa, Pseudomonas bacteriophage F110/10
MKLKERLVKFYTIVKTPEENIAVQQHLKAYGIEFGSGNGFMYDKAQVLLWVGDNLLDYTRKSDGSPMTFLWYEEELKEAIGYSKSTYDFRRVDFHFVTEKKVTAYTLHECDTGPTTELNGTYTLQALKEIIADMEEENEN

SEQ ID NO: 360 - protein, 235 aa, Pseudomonas bacteriophage F110/10
MFKKLFAWFREEESNDEPKVLESRAEEFQVEECYDPASRPVKYINAKQIKRLKELDAKVGDPVKAICATFFDWKRWIVDRNWRFSMMAHRIDEKVHITDSKTGTVLQWRATADSDLRPVGFLWRDIPLVRDAADLVLTNMPWMTSEEKEYAALMARKAIAALADKKDYIDKLVARKRSRDNYKAGLIDRALMMEKYVGVQEGDEWDIILKEARERLERSIPTESLTMDWERFTLP

SEQ ID NO: 361 - protein, 92 aa, Pseudomonas bacteriophage F110/10; identical to SEQ ID NO: 144

SEQ ID NO: 362 - protein, 103 aa, Pseudomonas bacteriophage F110/10
MEIIPMLFVLALAWGIVFMWTYMGITEYFKDNFPASATKDHREGIEAFAIVLGLLWPITYTVYASFLLLYATYSVLKVVLLPKWALSIWNSRKLLKRIAPWNK

SEQ ID NO: 363 - protein, 120 aa, Pseudomonas bacteriophage F110/10; identical to SEQ ID NO: 146

SEQ ID NO: 364 - protein, 97 aa, Pseudomonas bacteriophage F110/10
MRSVAELIKMGLEDYLVNGRDTYMCYILSDLAEEGQISHGEYRSFREWLLEEHGIPSWDSVISLLHRNYLLDTDLNWVNFYVWSYFDLIRKEENNEL

SEQ ID NO: 365 - protein, 71 aa, Pseudomonas bacteriophage F110/10
VIFDKYIISLDTFKDGTEEYVLFSRGDNGFTTYFGSFATKYAAIDHAFLLEYNRYPSAYEEADLYNWVVMC

SEQ ID NO: 366 - protein, 113 aa, Pseudomonas bacteriophage F110/10; identical to SEQ ID NO: 148

SEQ ID NO: 367 - protein, 167 aa, Pseudomonas bacteriophage F110/10
MLTCEEIEELKARIGSNADRLIHKVERGLVPPLDTSRGRKPSFFFNAVQPEMYEVMVELDGDYPLWVDDVLQGVARLDWYRPDERSIPLSAKKLLTIFASLSNINAHTISHLLRVEARQANRYYKAAEFAHEKLIDGFCKDELRCMKYPETFVYPKPDVPQTDQEEG

SEQ ID NO: 368 - protein, 143 aa, Pseudomonas bacteriophage F110/10
MQTETESWRSCKTNRGTIMYTVEVPEVPVVCDITDPNRRCMQWIRARIIRLKNNQSTGFEDIYVLEPSHVDLECRWREENDPEEHVRWAIAWFDADMCDGQKFRQLIRYDINNMFKWYGPANLTCAEVFTIEKSKVCPPYVDM

SEQ ID NO: 369 - protein, 190 aa, Pseudomonas bacteriophage F27/12
MTAKSYRPDDLVTPQEFADPQFAAINQKRFDLYIDLRVQGYSSWRVFRAIWGEEHMDGPAQARIFAMESNPYYRKQFKAKLNATRTSDLWNPKTALHELLQMVRDPTVKDSSRLSAIKELNVLAEITFVDESGKTRVGRGLADFYASEAEAQTATVAAAAEANGYVQNGEEGDFPSPTPEPTEEDRANPI

SEQ ID NO: 370 - protein, 204 aa, Pseudomonas bacteriophage F27/12
MTNSIKTFGDIQNAEMKELVAFYNAHNADATVKRFSDRKTAERRCLAILNALPAEEEAFQEEEAPAKVYKTRTSKKKEEEKAEEENLKPEEEITEEEALEEIRKMREEAKNAPEKAKEAKDLSAAIANSWKDPEVSKKRTQRHGVAVTVKGKRGEFRSTNAAFIEFGLPSSKHIRFRMQLKAAGKLTFEHEGVKYNFEIIEAGE

SEQ ID NO: 371 - protein, 202 aa, Pseudomonas bacteriophage F27/12
MLYIWEDQDIHHGTETVAFVGEARSNYLIIGFKLGDLFAVAEEATGQIVVSPLSRQGIAEWLNLNGHTPAEIISHGPGKHKNPYVWADSIALKNLPNYPNMRCVTTPFVGVDPAEPGNDTTVHYEPKEPSLPDLPEGPMSPPAPPAPPVPKAPKAPPAPPAPQVSRRPEPLGLRSGAIPSSPSPASDNDKPGDLPVEPIPTF

SEQ ID NO: 372 - protein, 105 aa, Pseudomonas bacteriophage F27/12
MSEKEQTANAHYWVTVSPTDLSSASAAQRLCETIQLNMTRGVAAYIKFYGSKGEALVTRVIPHQCELFVNDESGTNRRRTAMMIEYIRFKVPAGMSLVEHTKQPY

SEQ ID NO: 373 - protein, 73 aa, Pseudomonas bacteriophage F27/12
MAKVVRVDELKTGDEILIKLRPDSAARNRAIILSVELWHGEVTLELACPVGDYWEDWIGKYVSSTKVVLMKRD

SEQ ID NO: 374 - protein, 75 aa, Pseudomonas bacteriophage F27/12
MAKVMLACELTVGDEILTHVDVNDPIRRRAIVLRTSPAPHNKVSAEVSALIGNEWKDFGIKFARDYPIISLNSIE

SEQ ID NO: 375 - protein, 74 aa, Pseudomonas bacteriophage F27/12
MYRTPSSKFTFICNGLAQNTEVTVLLRTQKPEDVWVVDEAPSADLIRIHERSNKRRRRTIKIIDVDSVSILHKR

SEQ ID NO: 376 - protein, 108 aa, Pseudomonas bacteriophage F27/12
MTMVGPTGRRHWLRYETRYWECLDGQTLRLVFVINGRRYEINRRVNVDILASRRRFESFGRVLARMEISLWFAVCEQEGPWRGSVAISDTALWFHLTGELIHKCFTRR

SEQ ID NO: 377 - protein, 93 aa, Pseudomonas bacteriophage F27/12
MSVSYINQPEMVSGIEGWNSLTGSAIPGPNLQNVNRLLLKEDCCTDELQHALDAGWRLLAVCPQEARRPDYILGRFDPTPPSGPRGAARSIEG

SEQ ID NO: 378 - protein, 124 aa, Pseudomonas bacteriophage F27/12
MKLYQATISPPTFYRHNQTDEERKALEAEYISKFHVLLGNLKGVTIGTPGERNWEPSTWSNNVPVVCSEIGLGRLTASAWDLDSNYPYSITNLVLLWDDIDPEPLCDPCWSVWSWPQAGWPVCP

SEQ ID NO: 379 - protein, 70 aa, Pseudomonas bacteriophage F27/12
MNKSSKMPRGWAQPGAARKVHFFMADGRSLCKRWLYFGKTYNEIPALEVTCAVCEKKRQSPFEKFCDKIF

SEQ ID NO: 380 - protein, 67 aa, Pseudomonas bacteriophage F27/12
MSYAMFDFYIEDHGHAGMEIDPGSFYVGFSFGRDAMFYLAYIDGAWVSEMNKWLPEPKQEDHNEQVQ

SEQ ID NO: 381 - protein, 71 aa, Pseudomonas bacteriophage F27/12
MIKQDLYKQIAFAAVGSGIKMFVKLYCNDTILEVIGVEEVKIDGATRLRYTGRADGVDVHFFINEIDMVMV

SEQ ID NO: 382 - protein, 66 aa, Pseudomonas bacteriophage F27/12
MTPQFDAYERRIIELQTLSKYRRAGGKFAPVDGTQTGPWGPVDNELWAKLEAEVEAIYTSKRERKA

SEQ ID NO: 383 - protein, 61 aa, Pseudomonas bacteriophage F27/12
MTKAEQLLKARLEDIANAAVRRERLDWATAYTFDDGSSIQCRKLSGRSAFARNGWRLGSID

SEQ ID NO: 384 - protein, 305 aa, Pseudomonas bacteriophage F27/12
VSKPIPFNSIDGDVKFELEVVDGTKIVLVDVSVSTSQFRKFWPLADSLCWDEENAEFVPRYKSSYLQNATEVTTRAFLAFAAGQYYLRADQGRKDESEGVTSDESLTAMELDRENSRLDECLQNSIAREDKMAEVNRQLQLRIRDLEAEVETKNSAIKGRQRRIDELLKHSQNLSAQNVEFSLELESKKTLLEALDKSLETLMADKDRLETAAKSAIDLENKAAETNSQLALRIRELEAELESQKALREESDRSLDGSIANANNQYKLACEAREALSRAREDAEFYRIGMQRIAEIANRKPFEDC

SEQ ID NO: 385 - protein, 100 aa, Pseudomonas bacteriophage F27/12
MTKQINIDVSNFDEAFIQHIISGGFLFELDDYEVADRVLLNVDGEPAIQFELNAEMWNEETLGIPMDIDSDEFADELQDWVESKVNFAFEEWLSADEGEE

SEQ ID NO: 386 - protein, 48 aa, Pseudomonas bacteriophage F27/12
MTKSQINDQIRSAKIAISEAEMEGLRGQAMIALKAKLTALKAQYKLAK

SEQ ID NO: 387 - protein, 62 aa, Pseudomonas bacteriophage F27/12
MSERLRRLEAEYERIEREWGGLARYELEMLRIEINSEKRQSEVNGYLSVFGCGHAFHGRKYS

SEQ ID NO: 388 - protein, 460 aa, Pseudomonas bacteriophage F27/12
MYKLNPALRAVWRTRARYKVIYGGRASSKSHDAGGIAVYLAANYRLKFLCARQFQNRISESVYTLIKDKIENSEYNGEFIFTKNSIKHKRTGSEFLFYGIARNLSEIKSTEGIDILWLEEAHYLTQEQWEVIEPTIRKENSEIWIIFNPNEVTDFVYQNFVVKPPKDAFVKMINWNENPFLSETMLKVIHEAYERDKDQAEHIYGGIPKTGGDKSVINLKFILAAIDAHKKLGWEPAGSKRIGFDVADDGEDANATTLMHGNVIMEVDEWDGLEDELLKSSSRVYNLAKMKGASVTYDSIGVGAHVGSKFAELNDSSPDFKLTYDPFNAGGSVDKPDDIYMKLPHTTIKNKDHFSNIKAQKWEEVATRFRKTYEAVVHGKVYPFDELISINSETIHPDKLNQLCIELSSPRKDLDMNGRFKVESKKDMREKRKIKSPNIADSVIMSAILPIRKPKGFFDF

SEQ ID NO: 389 - protein, 127 aa, Pseudomonas bacteriophage F27/12
MIERHAVDAEVVERIRSLRMRLNVLDETLQRAVDMAMLSHQKSLQDLRTYEAQLWDALNARYGLSVEKTYDLRFEGEEAVLVEVPPGDGQGDDFIVESEAEALAAGQAALEVGEAAASTLSARNRTE

SEQ ID NO: 390 - protein, 72 aa, Pseudomonas bacteriophage F27/12
MALKLSSVHVRIDGPDGKVLSEGRAEFSGTAFWIAAQREMQLRHLVGTSFEGALTYLADNGYNVTFSKGEKR

SEQ ID NO: 391 - protein, 116 aa, Pseudomonas bacteriophage F27/12
MKKEPIHLSSMASARAIDAEFAFRMDEFMARVAKEHEALAARLNAENEALWGEIRAVAGLSATDFPNIAMAHDTSDGKLYVMDADELERVRQVCPCPDCASARAERMPSQASGGIH

SEQ ID NO: 392 - protein, 133 aa, Pseudomonas bacteriophage F27/12
MSLPSDKVMLRIVQSILAILIGIAWACSDYGVVAAELPQALQAHPARPGHSEVSARDPRLVEVEKAREEALEYVLSLRPEVIEAKARFAAEAAQQGMSTKEYAELQSQERMLAGTLLAFVAFLFIFSTMLPRL

SEQ ID NO: 393 - protein, 259 aa, Pseudomonas bacteriophage F27/12
MTDQNEFTPEAIEKAKDRIRKLTAMAADSSSPHEAAIAAERVKKLKDKYDLHDFEATGEIREEFDEQIATRYYSAIPNWMKFFSVAVATYNDCIMDFAGGINNHRASAKASRSARDGSTTKRWGHAVRFKGYKSDVELAVNMFNSLVEAVDRLCREYQKAQGFERFNVKVAAQFKLAATQEISYRLQSITRKRMELVSSAGTSLVVVKEAAVHEHFGDPGYKKSNVTKLMRLEDSDGRRAYAAGTNAGRNMEIVRSVED

SEQ ID NO: 394 - protein, 145 aa, Pseudomonas bacteriophage F27/12
MKKFCIDITNGLAGFIIWGGAIVLAASVLIIGPLAILLTGAWVICTAVVFALWFAVAGIYEESQKQTEYLKSIASIQARERGAGFGPEDAGPSASAPANPVEPKLSHPKLKPGAQLVSAVVLFAVLVVVLAAGDWIWNYFQALPK

SEQ ID NO: 395 - protein, 195 aa, Pseudomonas bacteriophage F27/12
MDTVPDPMKDKITLHGLGFIQVQLPAGRLHVWHPELPRRLCFHHSSIHDHRFDFESLVLVGSMENTNYYVDRSARLGELTHEGYEHSSARQACGGRGWEPVGSVCLRQRQEFIIGAGQQYSMSAYVPHRTNPLGDGRVATLMRKGAVHKWPATSYVTLGVDPETDFDRYQWSVPTLWEVVIDVLGGAEFQIPSIP

SEQ ID NO: 396 - protein, 310 aa, Pseudomonas bacteriophage F27/12
MNAAENLFTGFEDLGDDFATVEVNNEAPKTLEEASMGARPNSWKEPKLYREKCPKCAGTGLYRGPSSYGRACFACGGVGYKEYKSSPEQRAKSRAKAAEKRIEKIQKAEQYRGLKIQAFEAAHPDIIEWWTDNSFSFAQSLKDSLYRYGSLTENQIAAAKRAIENLAKHREKVAAQEAAAPTLDISGIEKAFEKAKDSGIKRPKMRLAGEGEEPLIVVVKEASANSRNAGSLYVLGDIYLGRITGGKFIKSRDCTDTEYGDILKMFEKPMESAVAYGRKTGQCSCCGRELTNHASIEMGIGPICAGKFFG

SEQ ID NO: 397 - protein, 115 aa, Pseudomonas bacteriophage F27/12
MATKADLELEVQQLRRVIKSREFEIEELQSRLRRHRDMIRRVRLYLWSRLLIHRRTAETLEVGDSIAKTIATKRHKVANDVLGIIQHLNDYCDSYAEYDYNDGAEHGFKISSDIY

SEQ ID NO: 398 - protein, 103 aa, Pseudomonas bacteriophage F27/12
MKYVVLKMTVRGMSREVPVIFPDLISHVNMAASALVALDAECEGFKKSGDKVDITLVSAGFLSSMDIDAKCDGQSDSLNGLKSRESVDDELIRMIDYTHGYVG

SEQ ID NO: 399 - protein, 107 aa, Pseudomonas bacteriophage F27/12
MASITVWIATAFLCTGDGCVQMPDHTSRRFDSKAQCEDVMLRAIDKMWERHQLVVRAVCTPYFLSSTEVPGFYSPPPQPPTGLNHMWDNWIRGGSIPSYEPGRGWSE

SEQ ID NO: 400 - protein, 133 aa, Pseudomonas bacteriophage F27/12
MNPLLPIVHIVLKDGEVLGVFDCDKSAKWYSNVKGAVVDSWVVESPNSSRSRLVKKECYKVGDRVMYRDEHGEGHGRILAVEPRGESARDEKELYHLYQIESNDPSVDIWMLDADIIGIYPDEKRFTSDEQME

SEQ ID NO: 401 - protein, 765 aa, Pseudomonas bacteriophage F27/12
MFKLSWIFGRKKDNAACSESAPEKVARIPQHDPLDPMIKLGKIRGWNVEPEKAPVIRSVKDFLEPGLSVAMDSAYGDGPTPAAKAAAGGQNPYVVPTMLQDWYNSQGFIGYQACAIISQHWLVDKACSMSGEDAARNGWELKSDGRKLSDEQSALIARRDMEFRVKDNLVELNRFKNVFGVRIALFVVESDDPDYYEKPFNPDGIAPGSYKGISQIDPYWAMPQLTAESTADPSAEHFYEPDFWIISGKKYHRSHLVVVRGPQPPDILKPTYIFGGIPLTQRIYERVYAAERTANEAPLLAMSKRTSTIHVDVEKAIANEDAFNARLAFWIANRDNHGVKVIGIDETMEQFDTNLSDFDSVIMNQYQLVAAIAKTPATKLLGTSPKGFNATGEHETISYHEELESIQEHIFDPLLERHYLLLAKSESIDVQLEIVWNPVDSTTSQQQAELNNKKAATDEIYINSGVVSPDEVRERLRDDPRSGYNRLTDDQAETEPGMSPENLAELEKAGAQSAKAKGEAERAEAQAGAVEGAGDPVPAAPRGTKPLAKAAEEGAGEAATPPSRPNPRAELRNLLSDLLSKLEALDDAQAPDGVDIEQDDAPGLKRTSKPSVSGMEPSVFSSNRIVGPRDHSELQRIKVNGITTLIENPRGSIRQGKDGSWRVQMKHHYGFIKGTKGADGDEVDCFVGPNLGSKRVFVVNQVNKDGQFDEHKCMLGFNNINDAKSGYLSCFRPGWDGLGSIHEVDLPAFRRWLANGDTTKPFGGK

SEQ ID NO: 402 - protein, 278 aa, Pseudomonas bacteriophage F27/12
MAFKASKKRERRAPLPVGRGKPIIPSAGIEAWYRKQMKDMARLMIADYRSEIEKAISQPAAERFFAKDESVNVLFKMTLRSLQQRWNRIFEGFAAKIAPEFVNRADEAATAATLHSLSVAGVDQPRASYNESVRNTLEAATTYNHTLITNIQEEVHEKIYTSVMLSLTSPNPEEQGTSGITNALREVGKFSENRIELIARDQTSKLYSSLSDERMAENGVEEFEWMHSSAGKTPRHTHLEKDGKRFKLNDPRLWEGPKADQGPPGWAINCRCRKIPII

SEQ ID NO: 403 - protein, 68 aa, Pseudomonas bacteriophage F27/12
MPLVHGTSNEARSENIKREIEAGKDPKQAAAIAYSVQRSEKGKEAKDCSPELVADLRALVDSLSRLVK

SEQ ID NO: 404 - protein, 45 aa, Pseudomonas bacteriophage F27/12
MNRKTCIRRLATDVIKANINGGFFSLKFAAVDLAIIGVSILIAFG

SEQ ID NO: 405 - protein, 478 aa, Pseudomonas bacteriophage F27/12
MAKSKRKIDENGYMTIEGCPISSYGIFQYSAGQLGLPGDPMRIVNVYRPESAVSDPEYIESLKNLPLIDEHEMLSGFDGDDDGVAPEDKGVEGIITANAYYEAPWARGDIRIYSRNMQHQLERGKEDLSLGYSCRYTEQPGIWNGTPYEVVQDKMRGNHIALVKEGRVPGARVLDGLCFDHLSFDFRPSDEGNEMGLKKAKQKTPVQRAGQAADSAVEELRALWPKLSASVQKFLGEEAQEPEHQEGAAAPAEPTDSEHMTEHPTLEGAQEDDEEHEEAPSVVDPAVAAVDPEQQEGAASEMSGEGEVAELISQVKAILARLEGTVAEEADEEHGEGQDVVEGLEEQSILCGAQTASDDGGEGKDNSEELPEMAQKNAQDAAIRGLYRDIAAKDRLYKRLSSVVGAFDHRAMDSAEVAVYGVKKLAISCEKGQEVLALDMYLKGVEAARGAASRQSKAQDSASSAPQCAELDSYLKGE

SEQ ID NO: 406 - protein, 211 aa, Pseudomonas bacteriophage F27/12
MFQKQVYRQYTPGFPGDLIEDGPKRARPGRIMALASVTPAATATGPNRISRAFGYAGDVGSLGEGQPKTVAARASEVVVGGATFFGILGHPKHYALYGSAGDSLAPSYDLPDGSEGEFFDMATGLVVEIFNGAEAALDLSYGDPVAYVPNNLPTADNALGLPAGALVGFKAGSMPTGLVQIPNARIVNAISLPAQSAGNLVAGVTIVQLTQ

SEQ ID NO: 407 - protein, 382 aa, Pseudomonas bacteriophage F27/12
MSHISKTHSRLAGRHAKPFDLKNVTHEAVAALGRIGLVFDHAVVQDQIKALAKAGAFRSGSAMDSNFTAPVTTPSIPTPIQFLQTWLPGFVKVMTAARKIDEIIGIDTVGSWEDQEIVQGIVEPAGTAVEYGDHTNIPLTSWNANFERRTIVRGELGLLVGTLEEGRASAIRLNSAETKRQQAAIGLEIFRNAIGFYGWQSGLGNRTYGFLNDPNLPPFQTPPSQGWATADWAGIIGDIREAVRQLRIQSQDQIDPKAEKITMALATSKVDYLSVTTPYGISVSDWIEQTYPKMRIVSAPELSGVQMQGQTPEDALVLFVEEVDASVDGSTDGGSVFSQLVQSKFITLGVEKRAKSYVEDFSNGTAGALCKRPWAVVRYLGI

SEQ ID NO: 408 - protein, 145 aa, Pseudomonas bacteriophage F27/12
MTVYIVSAMTQSVSYNAYDTSDPSNPRLQRKVLIRGRAGIASETSGFGDMISDASGRPIWTPQGDCTAVSDSDFELLQTNKIFMRHMEKGYLRVVKTDITNDHQRIAKETRTMERDGFQPLDSARLKQKIKVTTASASQEQEFRV

SEQ ID NO: 409 - protein, 155 aa, Pseudomonas bacteriophage F27/12
MVIFDEQKFRTLFPEFADPASYPAVRLQLYFDIACEFISDRDSPYRILNGKALEACLYLLTAHLLSLSTMQVQGAAGGGVTAGGTQGGFITSATVGEVSVAKLAPPAKNGWQWWLSGTPYGQELWALLSVKAVGGFYIGGLPERRGFRKIGGTFW

SEQ ID NO: 410 - protein, 132 aa, Pseudomonas bacteriophage F27/12
VIPGANLLRMAFSVIGTQLVQYRKFEQRTKNSQAQYVSVFGEPFQLAASIQRVRRDQYVQFNLEFQRNYVMIFANFEMVDLDRDLAGDQFIWTGRVFQLESQGSWFYQDGWGVCLAVDIGTAKLAEDGTLTF

SEQ ID NO: 411 - protein, 183 aa, Pseudomonas bacteriophage F27/12
MFDGELIEKLVVELTSAMTSAKETLQFPDFEVVQKAQPTQQGTSTKPAIFFQKLFDIPRGWPATDWYLDNAARKYVEITRQHVETTFQISSLHWQNPELDHVVTAADIANYVRAYFQARSTIQRVKELDFLILRVSHISNEAFENDNHQFEFHPSFDMVVTYNQYIRLHENAAYSADGVLIGI

SEQ ID NO: 412 - protein, 193 aa, Pseudomonas bacteriophage F27/12
MSLRRDSELIAAHLQMLRAMRGRSVSAGWYSTARYPDKAGGSVGIQVARIARLNEYGGTIDHPGGTRYIRDAIVRGRFVGVRFVRNDFPGETEVTKPHRITIPARPFMRYAWNLFSADRAAIQNRIAMRLARGQITPDQALAQIGLALEGYIARSIRTGPWVANSASTVRRKGFNRPLVDTAHMLQSISSRVT

SEQ ID NO: 413 - protein, 504 aa, Pseudomonas bacteriophage F27/12
VISQSRYIRIISGVGAGAPVAGRKLILRVMTTNNVIPPGIVIEFDNANAVLSYFGAQSEEYQRAAAYFKFISKSVNSPSSISFARWVNTAIAPMVVGDNLPKNIADFAGFSAGVLTIMVGAAEQNITAIDTSAATSMDNVASIIQTEIRKNTDPQLAQATVTWNPNTNQFTLVGATIGTGVLAVAKSADPQDMSTALGWSTSNVVNVAGQAADLPDAAVAKSTNVSNNFGSFLFAGATLDNDQIKAVSAWNAAQNNQFIYTVATSLANLGALFDLVKGNSGTALNVLSATASNDFVEQCPSEILAATNYDEPGASQNYMYYQFPGRNITVSDDTVANTVDKSRGNYIGVTQANGQQLAFYQRGILCGGPTDAVDMNVYANEIWLKSAIAQALLDLFLNVNAVPASMVGEAMTLAVLQPVLDKATSNGTFTYGKDISAVQQQYITQITGDRRAWRQVQTLGYWINITFSSYTNSNTGLTEWKANYTLIYSKGDAIRFVEGSDVMI

SEQ ID NO: 414 - protein, 150 aa, Pseudomonas bacteriophage F27/12
MINISAFGSIAQFTASRTFPNGFTVTEFADDADPIDSPPFTAADTGVGLNGDMVVWNRANILEVVVNVIPNTEGERNLAVLLDANRTGKDKSGARDVIGLVVAMPDGGKITCTNGTPIDGVLINAVASVGRLKTKPYRFRFEKVVKAGTS

SEQ ID NO: 415 - protein, 107 aa, Pseudomonas bacteriophage F27/12
MKKIPLTAVPNQAISFNAGSSYWKIRLYQNLDMMNADISRDGVIVCHGVRCFGGIPLLQYSHQYRPDYGNFVFDRDADWTLFGDGINLFYLDGVEFAEYQALATRKE

SEQ ID NO: 416 - protein, 116 aa, Pseudomonas bacteriophage F27/12
MSTSTIRTGANNDILLDDNGNMVILRDVEACAQDVRAAMLMRTGENIFDVNAGVGYFEYIFSPQKSYDDARKSIADAILSSPDVTGIEQLDIDITGEVFGVDAKVITIHGPVTAGV

SEQ ID NO: 417 - protein, 142 aa, Pseudomonas bacteriophage F27/12
MSTIRIQYANGTQLFLDGKNPPLLDPLPSFNPSVEDLEDLDREKNTGKGDSSSAGIPVPPVNVDPNVDNGGAIPAPASTGAPAAGSAPESSQEAPAEGQGDEKGSETPPTTAKEEKTEEEASTAAKEASATTKPTARKTTSK

SEQ ID NO: 418 - protein, 167 aa, Pseudomonas bacteriophage F27/12
MINVSGFGTGIVIVSTSSFPMGFSLSKFADDESPISSKELEPFGYEMLYDGGLFAFDKAAPLEVSISVIAGSEDDINLRILLNSKKGSFRFLPGVIPDMTTLVATLPDGGRTVLSNGTIIKGPAIDTIQNTGRRKGNTYTFVFGNYLGAQTARQAISNVIQSVLEVI

SEQ ID NO: 419 - protein, 179 aa, Pseudomonas bacteriophage F27/12
MLGIFTSLLSSRSFSIVDQNTNQLVAADLRISRVNTRFSSVGQRHMLEDGTTKMDSRTVHPMEIIVEVFCPSIDVVDQINQLLLDRDTLYKVITRGMVFERMMCTSEALNQTPEMISATPARLTFSQVLVQNPKPIMFRNAGDSSIIDRGLALAEDVVGSASDLFDYAVNGVQNAADLF

SEQ ID NO: 420 - protein, 197 aa, Pseudomonas bacteriophage F27/12
LNSFLKAILNTPTLTIRDDVTKLPVWKSLQVKKVEIYSPASVVSKPLATKDQTEAQVYTEALDIDVKNGKIIQPVRLRINAICPDLSTVESIMNVFNDNTSTFAITSKSILADKMAIMTLDVDQSPDMLNAAEINMEFEQVEPPVLNEFDPAFSQDRPTYGVQIQSLSDANLLDLGATGDSISSAAKSLYNRVTSYF

SEQ ID NO: 421 - protein, 142 aa, Pseudomonas bacteriophage F27/12
MLEINLPDGRQTRVQIEAWSALDGWELQRRFVEFAVSKDADFRRAFTMEILSYAKVILGNDDSEIPLTTAAVINNHLGNWKNVEFVFDSVLKHNGIDPTTHADRPDYWEQAGSQMAIAFLAEASKLIGPAMKIAEGLASKPE

SEQ ID NO: 422 - protein, 860 aa, Pseudomonas bacteriophage F27/12
MSSDLDEFILRYEADTARAERNLERLQNQIRRVNSASTSGLQDLRHFADGAATELGRVVPQVDAVTSAIRGMNAQLAIGATGVALVAAGVKAFMNTRDQYNQQRIQAMDIGIAPARLEEYQRKLARQSGGTISREQGAEMTKNLADTFRRAYRDIGRVGPEARILRMAGVDVGSFQKGMRPLNDIITELATKMAKLKPDEISAYADALGVSRDYLSTLAKIGPAMGKVTEMTSEELQARVRGESNIQKFNDALANLNQTFTTLENRVGEKLAPAFTKLIEIIDKIVQAIPNEVEEFAKDTKARWDDGITGKATVGGDILSLLSPGALLGRLASWGTRRGMEEAGLIDKSKVPGSQGQTSEDLAKKQEDQDKATKSMKELEKLADQTTKSTNDFAVAINMFSGAVSSFANAVDERQAWAAWAGEIGRAVGMGSTAPTSRATGVYPHAIYDQSKSGAAGQVFGEPIGAQSLRNRMFSPQRKAEPINVPSYINDIIKDASKMYNIPELDIKKLIYTESRFNARATSEAGAKGLMQLMPEIAKAYGITDVYDPRQNILGGTRLLRENLDRAKGDMRLALTYYHGGLDPKNWGSRTRAYPGLVMSAPIELMEEAQRKQKAAAMTVANETFAPEGGDMDIRPYDGGRLEAPDQGRKEDDRREARRYDDRVVRPEIRIIDRMPDRSDGEILKMSQRQDADRADSGFRKFPNQVRGETKQNIQTQLTAGAIAQVIGVNPNQIMRREISRSDLLFGYNQAILGKQQEIKAAATEANNVFLSPAKLAEATAKVNAASREMDILRTYGEKLLKSAPERGQELTIGRIDMLVNVTGANSPEEAREIFSRQTAEQLTTAIQDSQNDSATKILY

SEQ ID NO: 423 - protein, 287 aa, Pseudomonas bacteriophage F27/12
MKKRILRVTFNMPYGPEIIREDLDVRVRIMKAALRIQNRATLEIFGLTTQLRESLLSQFTAWKHRQRQVGMEDELMIRVSVEAGYSDQGREQVSRVFVGEVAIVDVISPPPDIGIRIQCYTRQIDRTKTIRNMPPANTTFVKFVEWGANEMGLNFICDTSYNDQVLKNPGRSITVASAILASIQDMYMPDVAAFVDDDILVVKDRDKVIRPDEVANINSFVGIPSWSEWGVEFQCLFEPSIRVAGGVAVESLMNPSVNGNYVITALEYDLASRDRPFYIKVMGSPAA

SEQ ID NO: 424 - protein, 177 aa, Pseudomonas bacteriophage F27/12
MAREIKSFNMFGVHYNSRQFSAVDGLRMMSGIHDVPPEELLKGTDVLAHTEEQPEGVWLPLTAANINLYVIDRANVIAPVQVLALLSELVIDWNFGFLKDWTGVKIPARFVEDIKSVKTAHSPSVVASLVANGSASMRELEEYYSTQDAFKMIDIMTAKSVNEALASEASQNRIKKG

SEQ ID NO: 425 - protein, 221 aa, Pseudomonas bacteriophage F27/12
MSNIPLTSAKSTDRTRLIAALDARSRRDALDFEVMIPAQVVQYDRAENIATIQPLITWVDTEHNAVQRHQLVDIPVISMGAGGFHISFPIQQGDIGWIYAADRDTSQFLESLSMSKPNTGRIHKFEHGMFIPDVFRRYTINSEDSAAMVIQSTSGATRISIRGDNIKITAPSNVTVDTPQANFTGSVTIANTLVVNGVNVNNHGHLENNPPDARTKGGMIA

SEQ ID NO: 426 - protein, 417 aa, Pseudomonas bacteriophage F27/12
MANYDYIVDTGVIVADTADVLKDVEAEFRAALGANINLAASTPQGTLVAAETIARSSVMRNEARIANTINPNVSFGTFLDAICALMGIERGSDLSTFGYGVQVTGRSQTRISTGSRVQTPAGAIFTVMSDVLIPATGVATIDVKSQDYGNIPLPVGNLIIIDGTIGWAGAKVIASTRVDPGSRQMTDAELKNARVNRLAIQGRNSTLAIKAYVSAVPNVTSVNVIENNTGTVQVVNGVSFTLPYAVWVCVAGNPDKQAVADALWAAHNGGTPWDYGSANNGVPVDGPTGVPVRDPASGRKYVVKWTTPIMYDGYVNVTVQQGSSSVAPEAIQNAVVNYAQGKVEGEEGLVVGASLSAFEVAGAIAREIPGIYIKLCQVACVPAGSPAPAPGDFSPEYVMSAFGQATISVGNVRVTFV

SEQ ID NO: 427 - protein, 504 aa, Pseudomonas bacteriophage F27/12
MTLPAYNSDIQQALKWLQNQAPGITGLVQRKAQWYDRFSRQFWVNWERDVFNLKTANPFGLMVWCIILGTPSKWFGLYPKNSSWAFGRLRQNFIYSGTQVPPPADASPGGNFYGGGNAEILNLDEIRKVLQLRYVALISNGSIAYINRMLRYIFNDDEPWDEATGLYFYLMDSTGENGPVENLAIYRKDWEGMVLLSSSPRTNHVLTSTPASDADWPGVDPAASGLPVTVETASATAPDGSATVCKLTKPAGSTAYVSAPIDGPLGSGSTVTFSFFAKAGSTRFIAIQSAADFPSRADAVFDLDSGNVISDQMLDSSVVSARMIRLENGWWRCVLTTKTVSSSFRAAYVAPAETNFSWIDSNSSAAIDVLIWGAQIELGDTPTGYLETTGAPVTITDYALQNAQTGTVKFTQPLPTGVEAYWTGDWKGGSATEPARFAVGDGTQDTFNLSSPAYIGLPTSGAFKLEYRVGPALNLSPQLINLMNDRAVGIMPTCAGCDVKVIQE

SEQ ID NO: 428 - protein, 964 aa, Pseudomonas bacteriophage F27/12
VITPELIPSPFAAQGDKDPIPQTSSTGFANLRDGYTPDYEISLASNNPQAKAVERKIQNQLFFIATQNAQAWQRQMAPPWFQGMPGGYEQNAEVVRVGNDGIMRRYRSMVNANASDPLSSTTWEEQPAWSVMRSNIPMPAGGPGLSSGGEVITTGRNFNDLLNGTWEFFSDSVVIASQNAPVYPAYAGAAAGMLEAKSWVSGANTFCVQRYTDRVGNVAVRGLNAGAWTNWMYAVNVMALQQGRVTYGVAAGSANAYTLTLVPQLQGGLVDGMILRVKFNTMNTGASTINVSGFGAKAIVGAANFPLTGGELGQGLIAELVFDATGDRWRILAGAPRIQVGNADQDYQAPSWKQVKDYVASQKLTEVDWADVVNKPNVAIQDTTPWFANLELSDARPFIDFHFNNNRAKDFDYRFISEADGSMAFYSRQGSAGPTQDILFSRSNVTFLQPRLDVAKNLAYIANSGPLWQNTTADQPGWKFTFAQGVDANNNAVIAVNTTNPDGSYRSQIMRWDWASTNVIFNNRPLFAGQYVPWDSGNFDPATKLTVGTTNNISGPTGIRNTTSNTGNMNTWGSSSTTASYGNATLQIFGRGGGEPAAIYFDNSQTGWYLGMDKDGQLKRAGWSLGNNSYVVTDESNIRFHVNSMAGTPVWGGNEFWGPWNFNPNTKLTIKAGTQETSSTAIFSGTMPFAPIASLSDYSQAPLTVYNSPTGPSAKPAVIAFIRPGNWGAFFGIDTDNKLKWGGGSLGNSSREIADSSNIMNLWAANPTAPTWNGQTIWRSGNFDPATKVDLNAANATNGNMIFNRIAGTGSGIASSGRVGAIRLQNGATAGAAAAVTFERGGDFFVNFGLDTDNVLKVGGGNLGANAYPVIHAGNYNNYINQALVQVGLGGVGSYGIFAVLDNAAPTATVQPGVIVDGSILIYSSCSANYNSGQRPAGTWRCMGYVVNRDANTPDSATLFQRVT

SEQ ID NO: 429 - protein, 142 aa, Pseudomonas bacteriophage F27/12
MKWTRIRNPRWLDAVNIHAMVTFEGIGEVPFTANPQDVEAHGRAIYAAILSGEHGPIAPVDSKREKALQDAIRAREKRAILRDTRWPIDRHDEQRRLGIETTDGPGLIAALVHWRQQIRDWNSGDRPRLPMALKTMFKNQEY

SEQ ID NO: 430 - protein, 220 aa, Pseudomonas bacteriophage F27/12
MKITKDILITGTGCTMDRAIKWLDDVQAAMDKFHIESPRAIAAYLANIGVESGGLVSLVENLNYSAQGLANTWPRRYAVDPRVRPYVPNALANRLARNPVAIANNVYADRMGNGCEQDGDGWKYRGRGLIQLTGKSNYALFAEDSGMDVLEKPELLETPAGASMSSAWFFWRNRCIPMAESNNFSMVVKTINGAAPNDANHGQLRINRYVKTVAAINQGS

SEQ ID NO: 431 - protein, 83 aa, Pseudomonas bacteriophage F27/12
MKRKEHRKRFRPRISPRLREELISVLTKIIGETVKDKVVRALLIGVLSSLGNYVDSVTQEESAAPIEVRKIEEAKPESKKAAE

SEQ ID NO: 432 - protein, 303 aa, Pseudomonas bacteriophage F27/12
MKPMFASMADPGLLEGQLPIFMSPKIDGFRAFIHDGHALTRSFKPQANAAINQYLSNPIFNGLDGELVCGDITDPKVFQKSSGDLRRRDGEPDWSFHVFDDFTDPRMPTDERLDAAEHRVKELRERFEMTRIHLVEQELVTSVEQMTEAELRHVGLGFEGSIGKKKNGIYKFGRSTAKEGHCVKFKRYDSEEAEIIGVEELMINENEAFIDELGYTARSSHAENLVPSGMVGSFVCRNEKVWPGQTFRVSASSLTHDEKQRRWNDREYLKGQVIRFTHFPHGAKDKPRHAVFDCWLDGWGASH

SEQ ID NO: 433 - protein, 184 aa, Pseudomonas bacteriophage F27/12
MIIERIMNSELHDLVVKWGSDRNLIKGSSAKDQFLKLVEEFAEVCEAYIQNNTAEVKDGIGDVMVVATIMAAQLGENLFDHMSAFVLAVERRPSYGEDLKLLGDLAGSLARGNRWLAIKSLVMAVASLFDAAEEHDTSMLECYQAAYDTIKDRKGVMYNGVFIKESDERYASIMAELNHANETI

SEQ ID NO: 434 - protein, 201 aa, Pseudomonas bacteriophage F27/12
MDWKDIGSKIGAAAPALGSLLGGPAGAAVGAIVATALGSKADPASVASALDANPEALARLAELQSAERVRLQELAIQAEQNRLQSEQNQLQAELSQFAAEAADRDSARRLAAQQNDFVRPAITFALLTGSILIIIAIFTFGREALMDPTSSVAIGTIIGYWFAELKSVMAFYFGTTKDGSRHSTASIINAVKSQIQKESKE

SEQ ID NO: 435 - protein, 298 aa, Pseudomonas bacteriophage F27/12
MAGKKTETSEATEETKAVAVANGGAVATTDVPDFMDLYAYDGAGFEGADADSYAIPFIQVLQKMSPQVDEDDPKYIEGAKAGMFLNTVTGKIYDGKTGLLIIPAAYRREFIRWAGREAEGGFKGSISVEDFKEMMKDPTKVKEVEGRLYAPNEDGSVSDKKSDYFADTRGHYVIVIDPETGDFGQALISLSSSQIKASKKLMTALSQKKVQTPQGLRTPPTFANLVRMTTVGMSNDKGSWSGVQFELEGLVKNPDHFKAAADLYKSFVGGEVKVDYSKQEQPRGDAGGVGDATEAEEF

SEQ ID NO: 436 - protein, 206 aa, Pseudomonas bacteriophage F27/12
MSEQELEVPEYLKDNAPGEIDYFGVMDEMAVEATDIGHRLLNLVDKASQLDGEILDLQKALAEKEEELKTLKRNTIPELLEELGQKTTTLADGRTVKVEPKAIISVKEENKSKFWKWLEDTDNDGIIKTKVLAEFGRGEMEDAKKAAEAIIEAGYDATINRDVHYQTLQAFGREYLEKGEELPDFIGVHEYKEAKITKPKVKKSKA

SEQ ID NO: 437 - protein, 519 aa, Pseudomonas bacteriophage F27/12
MKAKTFPVKGMKTEAMQHQFNALEASLNKRNFAYLMEQGTGKTWTTLADSVRLFLQGRVDALLIVAPKGVHTNWILREIPTHVAVETLCVDWRGRPTSKKARARLDRLYAETFSDEKVLRVFAINVDAINHQAGYDEVKRFLKTFRVCAIVDESTRIKNPQAKRAKKIVELGEKAVARRILSGTPLTRAPTDLFMQFQFLRDGILGTKSYRAFVAEFSVLVPSDDPRMIAIMRKLDGKRTVPPQLVEKDDLGRPVFRNLDKLRSLIEPHSFRVTKKEALPFLPEKVYKRIYFEMSPEQRKVYQRVEEDYHFVLKNEDFMLDVSFDAAAARSKLKQVASGYINVYGEPVILPPEDNPRFAVFTDLLEGLLEEDPERSIIIWAMRIHEIGQIAAYLETQGISFGTYYGETKEDEREKLIDDFQAKRVQVFLGNPAAAGIGITLTAADVAIYYTTDEDNELRMQSEDRNHRIGTVNSVLYFDLICLDSIDEKIQTSLEWKRNLASYVVDGVFEADVSTRDEI

SEQ ID NO: 438 - protein, 138 aa, Pseudomonas bacteriophage F27/12
MAMNDRETKAANVFKQRSLGRILVDFLETRRSGMSDSICLNRHGVQFWVEFKALEAWPKRTSTCPMARCFEPGQIPFLRERIGWGGRGFVLVKIGTDWLLLNPMLDLFDLNSRDLVEVASHAEGLDNIIQFLADLENK

SEQ ID NO: 439 - protein, 1035 aa, Pseudomonas bacteriophage F27/12
MSFPQLRVRSGYSYGAAYGRFPEIIERAKEIESPFVAIVDDGTWGHVRWEQAATKAELPRGFGMEIPIKCADDGEKELKLKAWALAKDTRKFYRLTSKTVQNQGLSPKEFQDADGIIKFAGEAYAHLDLAGIDYIDINPASMVAAHGAMETARAFGKPVVITSYNDMPSIGHVDFASAWKVRESVGLRHIATEEELWTRLRHIMTREEFDEAVANTHAVVEQLVDVKLAKAPMIHLDGDIVALAREGQAYRLSRGHIKEWTQAYEDRFQEEIKQIQLKDFDSYFLVVADLVAFAKKHMLVGPARGSSAGSLVCYLLGITEVDPLPHRLLFQRFIDISRSDLPDIDIDFADTHRYLVFEYLQQKYGTWNVVKLGNINTLKAASVIAHVGKRFGIPFHDTDNIKNSIIEYTSADERYGKGLEDTFEKTQPGRDFREKYEIASACMGDLEIHPSHSGVHAAGILVCNDEVIDFCTVTSEGIAQLDKPDSEYLNLLKIDALGLRTLGVIQDANCVTAQELYDLPLNDKAVLDVLNEDKMSGIFQFEGQAVRSVANAINITAFENIDHITALARPGPLSSGMATKYIERVAGREPVTYTIPQVEQYLSGTYGVFLYQEQIMSIVKDIGQFDWEQTSAIRKAMSARKGEEFFNKRRELFIEGAKTIGVAPEDAHRVWQEMVTFGAWGFNRSHSVSYAVVTYWTCYMKRYHRLEYAAACLRAAKDDQQTVSILRELAKEGVEYTALDPEHSELNWVVADGRLIGGIMNAKGFGPAKAERFLRLREEVKVARIALANCPISAQDVEDKADDVAALEAQILSAKVSRDKELEKLLKADLKELKAELKELKAQYKELAGSHLKTLQDWEKVAASLSNSEVQFADLNESHTLWGHAYDNPELVGVTSGNPIQNIRDIRDGDDGLVIVKLVKKVLSDENEPIRQKKRADQGKNPMYKGQSQFLDLMCVDDSVDQPIRFRIRPEKYLRYGKNIAEGTPTGSWFLIKGWKLSGIDMFIVKAVKRILTEREKAKLAAQAEKDSEEGNGDE

SEQ ID NO: 440 - protein, 184 aa, Pseudomonas bacteriophage F27/12
MRFAVWDTETTGLPFHQRVSLRKQPRIIEFAGVITDGETILDEVEFICNPGIVIEEIITKITGLKNEDLIKHPSFLDQRQKVRDFFSKADANIAHNLPFDKFMLTCDLARGKLGLEEVNFPSLDICTVEESAPLFGHRMRLQHLYEHYCGPYVQKHRALDDVRLLHEVCKRMGVYRAYQAMEAA

SEQ ID NO: 441 - protein, 342 aa, Pseudomonas bacteriophage F27/12
MARKPKNGIMIFDLDGCVFDDSHRKSFALEKQWDEYHSRLDKDKLNPHAVARIRNAIDSDLMIFFITGRTDNNYFQTRAKIHRDLGIAEHREYELIMREYGNTQPAPEFKRSVALDILKKIDGLTRIVAAFDDRQDIIDAYKGLGIDAYILDLEGCDAPFFAVATDSDPGSAPSDMAGETIAADSYSAPTLDEAFAQSPSPLYEAPAEEPTEEAAEDSAAPFAMESAWPGDGDADPDDFVEDVLNNLSSAAEIFRDRQSAYGRNDLMYGKIMEILFPNGMVAKTADDHRLALFVMHTVGKLTRLANSGFEDDDSVFDLINYSAFVHATMHSGRITPKDGQKA

SEQ ID NO: 442 - protein, 63 aa, Pseudomonas bacteriophage F27/12
MKIIIEKVGDVAQVEVTNGSESIRVTMNVKSFDLVQNGELFRLTSDGTFIEKTITQKAESEGI

SEQ ID NO: 443 - protein, 305 aa, Pseudomonas bacteriophage F27/12
MKISLISYTQNAWELLLGTKSTRMRGQDPATMTEAEKLDHWKYMLDTIRSPFEFVDFIFQIEGVSKNFTHQLVRTRTGAYQQETSRALEVSAVVQPEAFRWDFDEQATANGEPDPTYHAREELNRLWHDAIADAQTSYQKLLDAGASLQDARAIIPSNMETKIAAKFNLRTLSDMAKVRLCVRTQGEYQEAFREMRRLVLEVYPMFDSLLQPHCVATGSCAFPRYGSKVLNEDEIHEQSYDRFMSALETKPGQIPVVELPVKPIYQCKFYRPWMDRSAEQEELRREFWGSEKQEANPVAINGKSM

SEQ ID NO: 444 - protein, 68 aa, Pseudomonas bacteriophage F27/12
MSIELVYRTSDGTIFSSMCHAEEYEDRLEACRLLAEEIDRYGLHKEDAQALAMALVEKFTFTPIPEDS

SEQ ID NO: 445 - protein, 88 aa, Pseudomonas bacteriophage F27/12
MYSPDHPEEVPMSFLEMQIDPPQTRQTAPSFVLVGILYLIGDGRLDDKPFTSFNLSFGSREEAERARDKIIEHYLDRRDIRAEIIRCY

SEQ ID NO: 446 - protein, 72 aa, Pseudomonas bacteriophage F27/12
MGRIVNIKVVISRTTERDFMGSPYIHESYRTFTFGADTTMVAAIDWVKSQCPEIVDMLIYEPETVAAQQERY

SEQ ID NO: 447 - protein, 72 aa, Pseudomonas bacteriophage F27/12
MAVDPREAALKRALLAFFRDTDALGGGSLTITARIVGPEGDRKFRASYFLNGEKLSLSDIIAKVEAEDGPDC

SEQ ID NO: 448 - protein, 76 aa, Pseudomonas bacteriophage F27/12
MAREVTFSTDKNTTKTYATKINLERAIAKAEWLGESARYFIHMTEDGRLTPVFLLNSLPAGTGAVWCAQHGWNVVG

SEQ ID NO: 449 - protein, 333 aa, Pseudomonas bacteriophage F27/12
MIPDHKVIIVGAGLAGLIAAHRFPQAQIIDAATPTSKERHNALLRFRSPVIGQLTGIPFREVTVHKAIYIDGEFVSQPRIDYCNMYSRKVTGGLSDRSIWNMATEKRWIAPADYYEQLVAKLANRISWGRPFDASFFQFLRRQDDHVNIISTAPFRANLAAAGLDLGIDQSFGEGTSIVVSRYKLSIPCDVFQTVYFPGPEVGTFRASITGDTLIVESVTKGVVETVDGEIETIEWDSNWDLDEVCSAFGIRKKNLIPDGEPTVQTKGKIIPLGRDERESMIWNLTHEAGIFSLGRFATWRNVLLDDLVSDMDVIERLMTSSSYQKAKKMFVK

SEQ ID NO: 450 - protein, 296 aa, Pseudomonas bacteriophage F27/12
MEQKDQNEQTQGEELTKEQAAALRKAEKAAERQRKERERAEKAEAKAKEAEQKKAEREEKRKAEREKKEAERAEKAKEKAAAKEAERAEKAKAKEAEQAEKAKAKEAEREQKKAEKEAERARKAEEKKAAQEAQKAAREEERKRLAEEKKAEREAEKKRRKEEQEERRAKAEARREDLKSNGSRRPRATHFIPTGDGHGTPQAFSTRGKVFAYINEHCTVGEPVEIESFGEKVAHLLYGTSVRSYLSKLEIMGWVDLVAIASKEDEAGQGDDEKADEGQEHDGEGQGADGSDGEEE

SEQ ID NO: 451 - protein, 395 aa, Pseudomonas bacteriophage F27/12
MSASNFTVDQIEERFGFRPNSQQIDAINSVVNWYRGWCDRAHRRQVYRLAGFAGTGKTSIAKIIAELCCSMDWTVFIAPTGKAAARLREKGCVNARTLHSFIYRPIGEDEDGEIMFANKDSLDEKPKLVVLDESSMIGEWDEERLLSHRIPVLEIGDFGQVPPVRGVQIFHENSCDTIMTEIERNAGNIVRASMFVRQGKRLPCREYDDIVVRAGFDMSDDEMRTFLDNDGVILCAYNNTRRRLNARARRILGYKGAQPGIGEKLVCTGNQHEYGIMNGEQAILLDFKPVPEGQEDDDEPDEMLFAKVRIIGTNYERWVKFNPLSFSVEEDVRLEAQKAIGGFDFGWAMTFHKSQGSEWKRVAMLEENLPSIPYSQLMYTGITRAIEYLLFLRKS

SEQ ID NO: 452 - protein, 140 aa, Pseudomonas bacteriophage F27/12
MAEHIFTHEGTVVFEGRSRTVKLRRGNHHWVDPDRHRYSPQDGRAASQAVKGAVLVLSTVRWLPGAKKAAEQLKAFPYKGRVHALGAAWHYVLLRRTKNFYVDPHGRKYRRDTGWSVDGLLKLSLNSIKPSVGERKYVSI

SEQ ID NO: 453 - protein, 261 aa, Pseudomonas bacteriophage F27/12
MQECKISRDQLPVGNPNPNVDKTRDPNLKPGYLRRSRELDPALAVRIRRELIHAEASDLAMAGWVNSQSSLYGSKAFPRHSVVRVTGMAESETNIGMLIGFIEHRKHGEWAVLETGTKEGGAITIPVESIMRASFAEAEEFAEKWKRNLGWRLLRQLRECGALAGTEDEFLRRIINRYVRDLTILSHHKAGADKSYTDAVLKSIGEAWPQIPAGTFVGHRVAQLLINHKLGRAGTILNDLVDLLERFAAGRDKVLNIAICN

SEQ ID NO: 454 - protein, 320 aa, Pseudomonas bacteriophage F27/12
MPDLMKLSHRQVEALLGLSRNSYNWIHGPSTDSTLKALRRMGLVNLSWDDSVAGYMFGSQPCWSITDAGKKRILAIQGTLTEEPEQQFNPSPCRHEPGKSDSDRLAKQLETIARLEKELEESEKRGSELAASYCDGVVGDEYGHTYCRYRVERDAALAEVERLREENANLILACASLDSEKREMQHKWDAIIAMRGDALARVAELEMKLDKADYAYDNDRIHMRGLAARAIARAKVFDDGSDGADAESARSVVAILRELLAVGGASAQHSAPDGYALIPVRETEAMHDAVMALLYNGVARTDTQKLLDAYINAATNKESV

SEQ ID NO: 455 - protein, 149 aa, Pseudomonas bacteriophage F27/12
MEPKKPSPVDGVIMTSLDVLRKAKPEAQDEYALSMFATAIRQKLQRSRDKGRGGWIDCDENVLLDGFAEHALKGNENNLLDLATFLMFMWVRGIDDAKIPPALEKARQHKIMEAWSRIHEDGLNSARKASAARQFVEVPRRKGRPERLA

SEQ ID NO: 456 - protein, 358 aa, Pseudomonas bacteriophage F27/12
MKPHEIRLAQAEEFLRELGRGIPDDERVMVGYAEEATVQTDENGRKLNAGWWPVPWKEGKYINSRSNAYACISSSIKTPNPKTGQMRYWRGEASFGHGLALMVDDIGSGKGSKGDFDRDEFRERLEPTAIVETSPNNYQFWYFFKEPMSHMLQFKALLYSFVDQVLKKGGDNTVKDVSRYGRMPFGFNNKRGKDGNFKYADENGKPELVRLYHADYSKRYSPEEIAQAFGVRIIMPQMKKVEINRDDWVYDQVWLKYAEHICTKYKMGEAAGGQVQQNMSGKYRIRCPWGDEHTNGDPFGAYFRGPIPGAEHEYVFGCGHDTCRKEHRRTWAAFTDEVVLPYIVEQLERINRRHIGEE

SEQ ID NO: 457 - protein, 61 aa, Pseudomonas bacteriophage F27/12
MQNDPGILITAIGLLFLGLIIFFEGLKGWKIQVANFLASLLCFFFGLSALTFWFVVAFDVF

SEQ ID NO: 458 - protein, 551 aa, Pseudomonas bacteriophage F27/12
MDPLMTAASKAADDAIARNETHRAQKAARYAEAYAEPDLRKRARLLMLDQAFDLPVSRVVKGPFDDFITKYSSTSDSNYLAVYDTLFCKGDGTVPHPHFDEFRGRLVDHRGVAFNNKTLDPIDLMGALAAAALDDPSIKKTIETCCVWARRYRRNSLIETFEKKIPEWDGEERISTLLIDLFKPFDTELNRMVSKYFWLSLYCRINYPGISAPISLALIGGQDAGKSYFGLLICKELSGGRDLAPVQLDLSRHDQTPFLRNITGNSVIANVGEMSGFKKGDMERIKEFLVRSSDTFDQKFEPGETIKRQWITIMDGNGYDGLQRDDSGNRRFYPMFVAQLPDEDGKPNWVKPGDGNEPFKVDFTDFGRKFWQAMAECRAWIEEHGVDGYLNMVSEANREVQNFSISEMENARGVVRDDTIDMYLINVLISCEFEEVKPGKNSKTPGWRADTVSILKWFDILARKKPISRHLTPHLKALGFIPNKNGLNGWLLPVDKVAPGWSKNMQTTLPPFNDALVYLLRKGDPDMTDEAAMAKIRAVRAERAKMLGEDF

SEQ ID NO: 459 - protein, 83 aa, Pseudomonas bacteriophage F27/12
VKALYYGKLIDFRYWSGVYDGWILCEMLRNYGFEVDFFWEIAANSWIAILTGKMGGLLPRGLAAKFPNSRFFEHGLKLFYSEN

SEQ ID NO: 460 - protein, 62 aa, Klebsiella bacteriophage F391/08
MKRFVISSKPAAKLNKMASSELVKMQRDMARRYRSYQRGGQQGLPMIWDNMMRYLKSLQNNV

SEQ ID NO: 461 - protein, 86 aa, Klebsiella bacteriophage F391/08
MQNVKTPMIGDSVFIPFVTGDVSKPGENEKIGYIKGAAMIPFDKINAVYAETEKAKNSDAKIYSVRVDSGDVVKVIRKDDKWLAVA

SEQ ID NO: 462 - protein, 134 aa, Klebsiella bacteriophage F391/08
MTATKTEKFAWNETNAATAVEMYEKIIASDGLEVANSQGLIDIAKAVGAESHVKVRSKLVSAKVYQKSDKPRKVGGGSSLRKAHYVRVLTQHAIADGLIDDADGLASLEQMKLDQLDVIARMVGVQDEVKESAE

SEQ ID NO: 463 - protein, 89 aa, Klebsiella bacteriophage F391/08
MALIKGSVIKLTGTVVDELIQTGYQDNKVMTPPSVKVPEYIVLWVNPDADTFGMAINREVFKPEMLELSSREIYLLNYAFSVEEKEVVK

SEQ ID NO: 464 - protein, 75 aa, Klebsiella bacteriophage F391/08
MIFFPTESLILIAGFFAAACLYGYYNFMEIGSEQTDLLRRDFWFKKASICRRWSIIFIILAVTFGISASIIPAIV

SEQ ID NO: 465 - protein, 558 aa, Klebsiella bacteriophage F391/08
MIIAIEKQKAILTAANNLNFWGKRLRAKKLEICDELSKEHYGTAKHSSEICDWLDSNKPVKPAAEKRAQRVAVEDSRPVAAGQLNSSVESWKVIPGRRFLLTSIQNNTFPHANFWKTLQEAAKYLGATLLVSKYAYNKKGFQNGQGNDELKYDDAFSDFICDENVFLGNRETGFAFMAEINILPTADFPLSGFGETATAYGLKGLAIGHAKITAESVPAMKGDTVRRMYSTGTATLKNYIQQKAGQKAEALHNYGALLVEIDDNGNFFARQIETMDESGMFYDLNHKFTVNGGEEVTGHVAALQYGDIHAEKLDHAVAFASWGPCDDSLVNVLRPRYQIVHDVHDFTSRNHHNRASGVFLAKQYAAGRDKVIDDLIDTGRVLEAMEREFSQTVIVESNHDLALSRWLDDSKANIQQDPANAHLYYRLNAAIYEAIENKDDTFNVLDYALRNVAGCDFAAIFLTTDESMKIAGIECGSHGHNGINGARGNPKGFRKLGKMNTGHTHTPSIYGGVYTAGVAGSLDMGYNIGASSWSQTHLITYENGQRTLIDFKDGVFFA

SEQ ID NO: 466 - protein, 150 aa, Klebsiella bacteriophage F391/08
MKLTFIYNNRKSFTASNVVENSLVISRDSEGRPHVSYQKVNTVDGDTVLKALAAILPRPAEFKESGIVSQLVAADSILYEADICEIVEIDAAAAGLMFIVVSENDYDDTYLLGDVMDYSSSEYTPPLAIVPVMATRIKPAELADALTLFF

SEQ ID NO: 467 - protein, 238 aa, Klebsiella bacteriophage F391/08
MAFNKLAIKAIKLWDLDGTVINSFARVFPCMDDKGNLDLNMYREKACVHDAIMTDTLLPLVEYMRASLNDPTVLNIIVTARYMGKSDYYFLRKQRIRAGRGGNIQILSRDVLHRYIGDADYKEVYYSKDGIYKTHYFEMLKAEYPNATITMIDDNRGVLAAAAAAGLQTMDATAINDILSIGVRLAGESFIDEALDDDNDYQYLCERLAHCWEGMTEEERSDYGIKPQQFIQSLAIAS

SEQ ID NO: 468 - protein, 153 aa, Klebsiella bacteriophage F391/08
MTIVLIFTTFFFLAAVWFGVRAHDLRNAVVAADLRNKSLHQEILQTRAERQVAISKHQRVMNDLRNDPSNPYYIPPVTPQVAKRKQKRAGSDNSRKVSGSPSSNSGSSRSDDGSTAAIIATTAAVATYSGYDSGSSYCDSGSSSSSFDSGCSF

SEQ ID NO: 469 - protein, 74 aa, Klebsiella bacteriophage F391/08
MEVVIGALVLLSIVLFVITVKQGKAIKQLERTNGVLQKSYDNQTRLLHKAQLNLSECKAELESANKIYITKGMV

SEQ ID NO: 470 - protein, 658 aa, Klebsiella bacteriophage F391/08
MGFYAGRIGDKKVLSLTSGNNKDVNNHTNPGWDTIFHSDMPHVVVLETHERDLWDGGDWYRCTRMPDRIIQVLSADYDRVVLTEVEFEDGTRRFIYGTSLGVGAKAYNAYFSNTVGSQASAGTMASMKTNVCASADLHMDISFYFEETPGTINEKLRDGTGCMYTWGVNSEWGDRGPGPPVGAPIRPNFETIIKAGWVLYRGAFSGNIAGSVSPPNRPLTIGVDAMRHPWMRTTGVNSICLRGETLNRNMYGHMGPRYGQSSNPVGGPYAHNIQTESYQEVQYKAGFFRGPPNNFMGWENTDNNNAGSGWGNNAIYRDNNFRVPKRVRWYITNMKYNGQGFYAENVFGSRNQEIKISPREFIVNGINLMNTGWKFINQNDINYSPGNRPDIRVIATNVARFSGNPTVGNNGYVHFNQPLTRPDNGAEFGQGNVSEMHVTTVGVYNFRSDAQWYVKSNPPEIGNQWGPVWSESTRPLRLVGGTGSADIGGNLRTSGNASHHLATLWLGVNNSRNGACVVTLDWKNDEWIAAAGIGCYNPLEDLTQWSEVDSRLRIFGNHFQKRVHQIMCLPVNMCVPFHFIRGTVTQCGVIPGNNAMQMKAMWAPTTTNSATQGDYAIIYWLIARADGSVEVWVNVEMSNIMNMRVILPEVRIAVQRLA

SEQ ID NO: 471 - protein, 157 aa, Klebsiella bacteriophage F391/08
MSNDLIVPDTMSPEGMLVIEAYLESGSDVAKAALAVGMEEPKFREIMRKPEVKAYLTDIFMESGFRNRDKFFGILDTVLTMKMEELDETGMGSEMDIMDILKLMHKMKMDEMKMQIEYEKVKQAKAPIHQNNTQINLAGGHDSNYTDLLSRIVGAGK

SEQ ID NO: 472 - protein, 438 aa, Klebsiella bacteriophage F391/08
MEISRSYINTTDVVDFGVDKRFFKFPVSGLLATEGIVPNGPQCAIINALEDPRHRFVTACVSRRVGKSFIAYTLGFLKLLEPNVKVLVVAPNYSLANIGWAQIKGLIKKYGLQTERENAKDKEIELANGSLFKLASAAQADSAVGRSYDFIIFDEAAISDVGGDAFDIQLRPTLDKPNSKALFISTPRGGNWFKRFYEQGFREDLPQWVSIHGTYRDNPRVSLADIEEARKTVSKNYFKQEYEADFSVFEGQIYDTFSVSEHVQDLAGMGHFFAADHEFETILGIDVGYRDPTAVLTIKYHYDQDVYYILEEYQQAEKTTAQHAMYIQHCIDRYNVDRIFVDSAAAQFRQDLAYEHEISSAPAKKSVLDGLACLAALFQQGKIIVDASCTALIHALQNYKWDFQEGEEKLSREKPRHDANSHLCDALRYGIYSISRGK

SEQ ID NO: 473 - protein, 160 aa, Klebsiella bacteriophage F391/08
LASNVKYKRDAISIMRDGIKAQYKRGNCCAICDSQENLELHHYSTVALLVKNFAKEFQLDFTDSEVVLSNRDKFYKHYWHELVEDTVTLCVFHHQTLHKVYTKEPPLFSANKQKIWVEKQRERCMNPEAPRTSNTGERSGFAKWLPTDVKTEKSGFARFL

SEQ ID NO: 474 - protein, 403 aa, Klebsiella bacteriophage F391/08
MAIRDWLVTKLNRGQRIIRDLEDVSHRTNVKPFTTGKAYSSIEILNRSANMVIDSAAECSYTVGEQYKTITTYGTIRSKTLETLLNVRPNPYMDSSTFRRLIVSDLLFEGCAYIHWDGSSLYHLPAALMEVKADDKKFVNKFVFNNMIDYRVDEIIFIKDNGQNGGINSQITGQSRVATVINSLTKREKMLEFKEKFLDNGTVIGLILETDEILNKKLRERKQEELQLDYNPSTGQSTVLILDGGMKAKPYSQISSFKDLDFENDIARFNKDVCIALGVPQLLIDGGNNANIRPNIELFYYMTIVPMLNKVCSSLTFFFGFKVTPNTKDVVALTPDKEKEAKFVTALVNNGILTGNEGRIELGYEELADEQMKKIRIPANVAGSATGVSGQEGGAPNKDEEKQ

SEQ ID NO: 475 - protein, 239 aa, Klebsiella bacteriophage F391/08
MIDYKALKALFPNGLPEAHNVFATVKAHLTYQILRKEYGYAATNSKTWDQFKEAYAEATKPVPVASVSITGAPASLDYTKTVQLAATVLPTNADNKTVTWKTSDATLATVSSTGLVTALSKAGTVKITATAGGKSSEVSIQVKAPVVAVTGVTMSPKTITIEAGKTGKLTGTVAPANATNKSVTYTSADTTKATVAADGTVTVPANLAADSTVVITVKTADGNKTDTAIVTVKVPTAGV

SEQ ID NO: 476 - protein, 198 aa, Klebsiella bacteriophage F391/08
MQNINLNAEIKSVKAVGEGDNPPLKIKGYANTITKDRAGDVILSEAWTTSNALKNFMKNPIMLFGHNHSRPIGKILDLVPTESGLMVEGEVSAADLQIYSLIRDEVLKTFSVGFYIKDAEWDDMTETFIIKDLELLEISVVSVPCNQDSTFSLSKSVNHNDYMELRKSFVKSSQVQPVEQPELSNLEKFLVAAGYAKG

SEQ ID NO: 477 - protein, 460 aa, Klebsiella bacteriophage F391/08
MSYDIAQLSKDLGLGDIAEQLKGLTASQKAEEARKFAAEQEAKELKRMEDLVAKATGEDRKNLAEALELVKNLDEKSKQSAEAFVKAMNSQQEEITGLKEEIKSLLAARENGRSFVADGVAKAMFGKQEDFEDEVEKLVLLSYVMQKDVFGTKRGEAHLKAVNGSSSIEVSTEAYETIFSLRILRDIQAKLIIGTMFEELPMSSKLLTMMVEPEAGEASWVDASTYGTPATVGAEDKTKLSEITFKTYKLAAKAYMTDETEEDAIFTLLPIMRRRLIEAHAIAIEKAFLTGTGAAGTPKGLIQFAKDDGKVVATTAKADGSVKVTAKEIHKLRRSLGRHGLDLNKLALVVSMDAYYDLIEDEEFQDVAQVTATTAIKLQGQVGRIYGLPVLVSEFFPAKAASAEFCVVVYRDNFIVPRQRAITVEKERQAERQRDAYYVTQRLNLMRFFENGVVAGAYAA

SEQ ID NO: 478 - protein, 170 aa, Klebsiella bacteriophage F391/08
MQFMTDSDWRTYGGLKRPDLESNIPMLIKAANALITQLLGIDDTANVVDVLPTKPARKKYFLSSPVPSTITKITINDQEIDKSQYKNYPDGTLLLKFSPPEGYMEVEFTQTGFTSIPDDLVLAACFLVDHWVKKDYRESRTFGGETVTFNTTKSGVPEHIRTIIEVYRRL

SEQ ID NO: 479 - protein, 253 aa, Klebsiella bacteriophage F391/08
VALGDLARQIVKEQLDIMSGGSHSTKNTVIYSAETMDNHKDGTIGKVSFRFTKPVSEDLLNVRTSSILKAVSSSLNLEGDVGVIDNLLNSITGKKSKIGRKRSTGRVEVNFGDPSDADNGYAGAISGASGRFVSNTNLRALLELVAKEYLVKDMKKAGAPLKFRTGRFANSLKIKDVLLREDAGAKTPDLNITYNYMLKPYSVFNPAVSTYRGLSLRPFPGARNPQKLIGEAIAKAARDLIHSRYRIRVNQGT

SEQ ID NO: 480 - protein, 161 aa, Klebsiella bacteriophage F391/08
MNYRTSIADALVERLKKDMDGSNPTEFFTNMYGNVSRQTYSFEQINEFPYIAVHVGTETGNYLPSAQQWVYLEIPILIYDKEKDDINMQLEKLIADVKTSIDTGGNLQYTIMKPDGSTIDSEATDMQITSVSTDEGILSPFGFAQVNVTVRYMPLRRALDR

SEQ ID NO: 481 - protein, 375 aa, Klebsiella bacteriophage F391/08
MSVQLLRNTRIFVSTVTTGFTKANTQEILVQDDVSWSQDSNSTDITLNEAGPKPTRGSQRFNDSLNAAEWSFSTYILPYDDAGKQILPDYLLWHGLATGAAVNLAGTTGVFQNATNLVVNFKDNGYHELAMLNIYILTDSSWSVIRNCQVGQAEVNVDIDDIGRVTWSGNGTRLETLASQPFDPKTIGIDDALYAKIQSSYIKNKLTILKLKNNATGGKTYNIPITGGSFTMNNNVTYLTPNIMSRVDVPIGSFTGSFELTGSLTAYMNDAANGSIQLYKDLVSDLKAVNDFEVAIILGGEYDTARPAAVLVAKHANLNIPSIETDDVLGVSIEFKAIPTQMDAGDEGYLGFSSKYTKTSIAKLISSGDGNPVTP

SEQ ID NO: 482 - protein, 295 aa, Klebsiella bacteriophage F391/08
MLYSLMRESRVVIEYDGRAYGFDALSDYTAGTSYEEFKANRRTIHRRSNYAYSKITAQSPSSISLTLNFSSNALEGLFFELMGFIEIDGMYQMPLFSNNIEPKMFSVYIINKNTSLRFDNCFATTCDFSLDKSVPVLNVGIESGYFEEVGHPLNSYTLDQGEVLPFSLPQVSSNGRVLPGLMSAGMSFQQQCEWRGDRSLFDINKIYNNRRAIVNELNSSALISMYYAKSLQIDSTHNIKPDIGLPVQIRNKYIVVDFPSTRITKRLDLTDVYKIDYDVIPTEQSDPVRIKLIGE

SEQ ID NO: 483 - protein, 140 aa, Klebsiella bacteriophage F391/08
MSINLKDIALDTKQITIAYPGLPHFKLKVNYVSRKLSKKILEAAQENQFVNGIAVKVQNDDKFAEEFVKVAIAGWEGLTVADVEKLMLIEVPEDRLEDKVEFSIDNAMMLVRNSSAFETWMNSTVFHLDTFRGSKSEPTA

SEQ ID NO: 484 - protein, 108 aa, Klebsiella bacteriophage F391/08
MCESLGEEPNPEVLKRFVEIHDFPEIAQTALTIYNNLSDNYIPGDYPTYLGKDKSALLVFFDIYGVEDADEKSLILQIINIFDSHAVAASRKRVEAAIKKSKMKSSSR

SEQ ID NO: 485 - protein, 1692 aa, Klebsiella bacteriophage F391/08
MTDRLIRELLVDIKQRGGSKAAKQIRDVEAALDGAAQSSEGLNTSLGKLPGSFTALERSVSRTAKSLEKLSSTTSITALAASIGMLSGKFTSFEVDLAKSVLKINANLNGVTSAANKMASGFDTAATSSVADLNRVNKALQELDAHASSVAKVLQTLKAGAGLESISSSAAKASTDLSHLVSGVEKIGNQLARMAEQAVLAGRSLQGLKADSLGAAGEHLSKAASGISVAVSSMGEEVNKLNKLLLELAVKADLASKSIANIAPGTKLNSLGTEIQKINTSLATAANTSVAEISKIKAALTSLVSSTATAAASMKTVGTGSGLSKLISEISAATSASTSDISKVTAALKQLNVDATAAGKALQSIKAGANLSSVPTVVGKIGTSMTQLRAQLEGSVTGIEKSLNDLSRAFATMGGTGNLNPLGNSIRGMIPSLTQLAKAAVQVNSALSKIQAGRGVLQLPTQFKAVTASLNALETKLASTSQILERGFSKGFQDMASKSTSSSTRMINNFQKVVPELNAIEAAAIRSAAAIDKLIAKRIRLGQAGGGGNPAAFNMGALVAEMNRIVTSIEAMGNKMNTTMADMARSTDKVSDKLTDLNSGVRDVNTGLGGLNSTLTGTGSAANRASRALGNTSGSARGATRNFAALAMVTGPMPLIYGAIASNVYVLKAAFDQLKLGDQLNRLEQFGSIVGAKTGTPIQSLAVALQEATGHAVSFEEAMRQASTAAAYGFDAKQISEFALVARRAAATLGVDMTDALNRVIKGVSKQEIELLDELGVTIRLNDAYAEYVKILNAANTGITYNIQGLTSFQKQQAYANAVVAESTKRFGYLDEVLRATPWEQFAANADSALRKVQQAAAKYLGPVIASINAAFYTSKASVSAEAATAQQESIKQMDGKDSNAVVMNLEASQKGLDDAVKAKEEVKNKLAALNKEIMDREAKMDMSTALATAANYSGFGNLLTLGASKANKEFTQQTADMRRQAYMLQQELADSAGAIQKWKDARDSALSKAQKENPELAGKLNIGQNVEASNGLYTFDNAALDGAVALRKEFNNIKKTSGDLSNDIQNFAQDSNTASRATAALGDALKAVESLAGGSTEKANQMTKDLNLGYSTVTEMNTAYKAMSNYQKIVNDEAKSKLDVEKRIAEVYAATRNKDKAEEAGRALEMQQLSAKKEALKAVLATNKDNKAIQKELTLLETEELKVKNQGMEATKKEKFYKDKIVGIDREIALLNNRTMTDSQYNVANLKLNLQVEKDRLALLKTQADKEKEAEQSRRNIASIEREIWKEQLDRNAKTAEMRKEEFERNQSMKPLMGESQKMQEQLAFYQEMKEFTKGNADEQARWSKEIANTTAQMAALKAQRTAQMMDRVGQSLGADYTPTTGLEGEDKKFADMENQMASYDTAIGKLSQLNSEATATAQSMGNLANAMIQFSQGSLDTTSMIAAGMQTVSQMISYGTNQQISAIDAAIAAEQKRDGKSEQSKNKIKKMEAEKIKLQQESAKKQIIIQTAVAVMQAATAVPYPFSIPLMIAAGLAGALSLAQASSATGMTDIAGSGGETASYLTLGERQKNVDVSMGANAGELSYVRGDKGIGSANGFIPRAEGGNTYPGVSYKMGEHGTEVATPMVPTKVTPADKVASETSSGGARRPVNLNIQAMDAKSFMEYALENPAAFQAAVELALNEQGLSLKNLN

SEQ ID NO: 486 - protein, 204 aa, Klebsiella bacteriophage F391/08
MRLPDPFTHPQYNGLGFDKATLIDNDPVIRDELPNGKVNEVKTATQYWGLNISYPVMFPDEYAVLSSAILEYKRTRGYLDVILPHYESYRVRGDANNCRIAAGQKGSTLVITNTNSLSGEPKPGDLFQLTTHPKVYKITSFKNVAGVWTLNLYPDLLLTTNGSERPRFNGILFQTKLMNGDSFSEEITVDGVYDGVNLVLRESL

SEQ ID NO: 487 - protein, 948 aa, Klebsiella bacteriophage F391/08
MRQILPSAKAYLANNDKIRLAYLVSIELPGSTGNNAVYAYMTDYMRDINYGGILFQSGKIKTISSHKQNRTLTVGSLSFSVTGTDANEVIKLVQSGVSFLDRSISIYQAIIDDNGEILPVDPDTNGPLLFFRGKIVGGGIKESNTVSGVGTSVITWNCSNEFYDFERVAGRFTDDASHRGLEIVNGELLPSHGAKRPEYQEDYGFFHANKSVNFLAKYQVKEERYKLESKKKLFGLSKSYSLKKYYETVTKEVDLDFNLAAKFIPVVYGTQKVPGIPVFADTERNNPNVVYVVYAFCEGEIEGFLDFQFGDAPMICTDQTDSTSRTCFGQKRVSGDTMARISTGLPSTSLSTHGQEYKYNDGNGDIRIWTFHGKPDQTVATVLRDIAAANNFFLQGENGNGPEYWDSRYKLLDTAYAVIRFTITENRTDIPEVSAELSGRKVKVYQADGSVKMDKTSQNGVWQTFDYLTSTTFGASIPIDRMVIGDWRKEADLLNIIDTSYQTSWQPFWRYVGWESWTAENRQIMQMNTILDNSNSVFKNVQELLESFQGALNNLSGIFRITVEKDSKTPLELNFLDTYGDLDLSDTTGRNKYNSVQASLIDPTLNWKTNSITFYNSKFKNEDRGVDKKLQLSFANITNYYTARSLADRELKKSRYSRSLSFSLPYKFLGIEPNDPVVFTYDRYGWNKKFFLVDEVENTRDGKINVTLQEYGEDVFINSTQVDNSSEAVPEISNNVLPPRDFKYTPTPGGMVGDVGKNGELSWLPSLTPNVVYYSIRKSDRVDPYIVQQTAFTPNVRMFQDIVGEPAGLTIFEIRAVDINGRRSSPVTISVDLNSAKNLSMVENFRVLNLAPDPAEWVGPDLELGWDKLQEEGLISGIFYTLEIRDNTNKLLRSAKITSLYNYSYLLGYNKLDYKANNSNTLGIYRALQPRIQAEGPKGEKSVAWAYI

SEQ ID NO: 488 - protein, 3463 aa, Klebsiella bacteriophage F391/08
MISNIAPAKMVLQNIVTGYTIASIQHSIFSDYDVIGRTFWLTTGGVTTRRDFTGVDTFIATINNLIAGATYSAQGAFYDSMVDAELMAAKVGMNLSSTINFKMKTAPKITKVSSFAESVDVGVGAPMVVVELSGEAEYVTIEMKPEGSSTWTKYYRGPITEQIIFGGVPVGRYNIRVSGVVTMPDGVTVDVSGYDTWPSLFNLTYNFTPPSAPTNLRFKTAHIQDGMERFDVRLEWDWTRGTGANVREFIIQYISNDEFAKTGWTKANKLNVGAAKAGTITSFPYKIRHRFRVLSVAWGPDTQSITNSNEVTYIIDESTTFDNAFINETGVEMTYAGIKGKLWNSNTKQWEQTFLVDAATGAVVLGTLDENGKAPISFDPVNKIVNVDGKVITKDINAANVILTNLTGKDNPAIFTQGKKYGNNAGGVWMGVDNVDGKAKFDLGNNTQYVRWDGDTLRISGNVVIGTPGGDVDLETGMQGKQTVFAYKLGTSLPSRPLDQVYPPAGWSAFPPNRTAQNQNVYVVQGTLDPKKSPPALVDGTNYSAASQWSGVPGTGGTDGSNGDYTVQIYQISASKPTKPGNINDPSGWSRTPPTGTPLWMCSGRFNGDTNALTVEGWSDPIRVDGEKGATGATGATGPQGPQGPAGGSVEVQWSKDGTTNWHANFTTGDIYMRQRVGTGGWSSAIRAVGEDGTNGTPGSKGNYIGMRFRVAAEKPATPTGQTPSGWSDAPPQGNPLWMVKAEFNGQTNALVGTWSEPVRIDGEGIGVNLYPVKKTLDQWTGMSNGTMVKNPDTLSFTITNTESTTSSTGPGAHPVPFQGSQGPIVEIPVKPNTAYIFTYEVSTDSTSFVLRDLLLEFSSITGSFTNFQELLTGAKGKQEAKIVTRADTKFLSFRPGVRTAGATVTYSNLKLEEGIKATAYSVEASDSIGEKGDQGTQGPQGPQGNQGPQGNQGPQGAKGDNAKGFSLSSLGQTFTYDAEGKLKSDATILFQAFRQNTTANVTWSAKDEKGGNITLTSTSNTGATLTAANFKTSKSVVVTAVCDGITDQITIVRLDDGSNALVGLLTNEGSTVLANYAGYVQNYSTGSGDFKVFYGAKDITSECTFSTMEKNNLDADITSAGKYTLKGMPAGTDVINGWVDLRAVHPTYGAVVRRVATTKSILAKGYDRVITTSFENGNKGTWSTGSVQGVSGATIVAAGFSKALVISARDCIEDANAFPVVAGQKYRLGMWIMASESKVNINMGMRIVRAADGVVDWQGTLMIAQGTVVPGGWSYIEKEFTVGSSNTGIAMPWIQMAGSSGSDLGKAYVTDIHIFALEMDGEKGDTGATGATGSQGPQGPQGNKGDKGDTGATGAQGPAGSSVNVQWSKDGSTNWHAGFQPGDIFMRQQVNGVWGSAIRAVGEDGKNGADGTDGDYISMKFIVQDTKPGTPTGNNPGSWSDAPPVGSPLWMTKGTMNASGQLQGTWSNPVRLDGTINPNLFAVRKWMAGMTGTEAGTSKNDIEKLAHTLTRTSGTDNTAPGCYATPYLGSGAFSHPVTPGKRYTLTYNIDAASEVQTRDTIFWQANPDSGQSTYIEELNTGTSIKVKRTFVVPTGMNYLTLRPSALTLNVATTWSKIKLEEGGEKTEYQVEYSDSIGIVGKSVLVQWSKDSSSSNWHDTFQTGDLFMRQNVDGVWGPAIRAIGEKGEIGPDGKKGNYTNIIFRISDTKPAKPTGNKPTDWFDAPPDGSPLWMATATFNGDTNAIIGAWSDPVRIDASGVGENFLAFKEWMMSIQRAEGTGSSVSKNPDQMRFRVTAGPSRNDAYTTPYQGTGTHFIEVSPNTVYTLSFEMETAVSTRMMLLQFDNGNGGTHARNNQVISTSTGINSLTITTGANTTHLSMRMSISNMGETNVLMKPKLELGAFPTAYVAHPSDLLGKDGATGATGPQGPQGNTGATGATGPQGSKGDTGATGPQGPQGPKGNAGENAKGFALTSDYQSFVYDTVGDIKSATTILFKGLKQNTTAGITWSAVNNTGAAVTLMNSGDNRQLTAANFGASKWVTITATCDGLSDQITVVRLQDGENVLTAVMTNEAATVLANYSGYCQSYENAKGQMRVWYGSTDVTGQCTFSEGGRSNVTPSINSANGNYSVTGMLDGTDITEGWVDVKATHPKYGAITKRFAVTKVFLAKSYEMVITNTFENGNKGSWAGALQSVSGPTNQSISKALRITARDNLEGRNTIPVAGGQKVRIRFWYNPLGLEEAIFRVGFIVHRKDGGKGYPSRTVVTGPAPNSSWAYFDQELTLSANDEGIAWPWFQLDNKTSGSSLGYMLVADIHFEDLSMDGADGATGPQGPQGNTGATGPQGNKGDTGPQGPQGPAGASVGVQWSKTGNASDWHTNYATGDIYMRQQVNGVWSSAIRAVGEDGRVGADGKYTSLRFQVAATKPARPTGNSPANWSDSPPEGSPLWMVKGEFDSSNQLQGTWSDPVRLDGETVNLNLFANKAWIASITGASGSGSVVAKNPDELRLRITAGSGATDAYTMPSGGDGTFFTKVTAGKRYTMSFDTDSALEMRMHVFFIQAGANTTTSSFSWIASTTAGRTSWSFTVPAGCDRVSVRVSLNNNPGGTNVVSNIKLEEGDFATAFIRNELDTIGADGSQGPQGPQGSKGDKGDTGATGPQGPQGPNGTSAKAFALTSDSLSFSFDTSGNLKSNGTIKIDSWRQNTTAAITWTAKNQAGSNITLGGTATNKTITSAQFGSSEYVTVTATCDGITDSITIVRLQDGVNSLVGYLTNEAANLSCNSYGFVQNWDGTTGNFKVFYGTVDVTSQCTFGVEDKSNLNGNIGSSGYYAPSAMPNGLEITSGWVDYKATHPKYGTLIKRFTLKKSLPGIGYDRVFTGSFDSGNNGSWGRTVVDIATGSPGGHTKAIQCTSRDTMESSNWFPTRKGMRYRVTAWVNNSEGEYQLRLGLHTQNSSGSVNTGYPTMLAASAKDSEGWKLVTGIVTVGDGSTAETGRARPFIQMNGSASPFGNAYVAAIAIEDLSMDGADGATGPQGPQGNTGATGPQGDKGDTGPQGPQGPAGNSVNVQWSKDGSTNWHSTFTSGDLYMRQQVNGSWGPAIRAVGENGANGTPGSKGNYVSMKFAVMASTPSRPSGSNPAGWSDSPPPGNPLWMIKAEFNGETNAIIGNWSDPIRLDGDSINENLFYFKAWLDSITGVAGNGSSIGKNYELLRARIIAGTGVTDAYTLPSDGSASMFTYLPPSTTYTMSFETDNAVEVRCHVFWYAKGSNTTGGVLKTIASTTAGLSSFTFTTPANSDRISVRFSVNESGGNNVVGRCKIEKGAFVTSYVRNQYDAVGDRGPGFYTQAITNLTGWNDTQAASFFQSTFGGPPVKYDVLTQYKSGSPQNSWTRQWNGSAWTAPALTVHGDMIVSGSITADKIIANNAFLAQIGVDILYNRAAALSSNPEGTYTMKIDLANGYIHIR

SEQ ID NO: 489 - protein, 139 aa, Klebsiella bacteriophage F391/08
MSTENRVVDIILDQNVSYGLMLQFMDIDDSAYPATETPVNLTGVTLKSSIKDSLESTGVKLADFVVTVVNATQGQASLGLTAATVATIVSKASKERDKYNPRLRFAGYYDVIMTKGTGATATSYRVMEGSVYVSDGVTA

SEQ ID NO: 490 - protein, 679 aa, Klebsiella bacteriophage F391/08
MAITTRIIAQQVTALDGANSRVSKYPKFTVQLGYSVSSLAATELLDAATRSAASAAAAKTSETNAKASETASKNSQTAAKTSETNAAASAQVAQNLAGKASLVTPLGVMTGSAEAKIASITIAANQSSSVHVLFALYATGNGANRDDIYNMEIVSLALPGPVTSVTADNIGSFLSHRVIGPANTNGFMVGLKSTIEGSNVTYDVYLKSRSSFRDPKMAFLSGSISVTPPTGPLVDGTSPAWKTTGFDTDVIYVNRAQVIDDGISLARIKQLAITNGKTDSSILLLSYLNETGILSTNKKSISLRPGGTSDSSIAATEFLPNGNIILPNGDTGNQTISWLGGPRIRVNSNGSFVLSTNNPSNQTSGFITFRPQGDQVTSTELQIRDDGNIKQTAPQSSAGNALIRQDAAIQHIMDKAPAAGITANPLSDLNVIPTPEGTDPWGADGVRVFQSGVSTKNTPDGTTGRLGTILNVRHTQYRIMQFFMQSNATAPILHIRSLRADQGNTPPAWFKVYTEYSKPNIQSDIAGITIDGNGFVKKASPIAKLIAEIPSKEDSFFWTGVETVGGYVGCNAEAQGVFAVKTGLGKYTIKGSLGWNTEGWKFELPRDDNGNMLCFVESDWNEEEKELNIQVFTRKFDINTGNIIAGEPMEIPQGRWIDLRLEMPKVEIPEVEFPEDPEV

SEQ ID NO: 491 - protein, 147 aa, Klebsiella bacteriophage F391/08
MRIKLSHPDCKPHVGSSEAAGMDLRAYFGDRASDLLRAIPPGESLMIDTGVAVEIPEGWVGIVVPRSSLGKRRLMIANTTGVIDSDYRGTIKMNLLNMSNETQPIDNFERLCQLVIVPHYNPNDIEIVDSLTDTDRGEGGFGSSGKM

SEQ ID NO: 492 - protein, 292 aa, Klebsiella bacteriophage F391/08
MSKSWGTMKREAEQRLASRRNLMIVDGTNLGFRFKKDSGKPIAASFANTINSLANSYDAKHTIVLGDKGKSIFRTNIFPEYKGNRDAKYADRSEAEVEADRQFFEYLDDAFDLIASQFPTFRIRGVEADDMAAFIIQLIGHHYDHIWLISTDGDWDTLLAPNISRFSFTTRKEYHEKDMFDNHNVDTVDQFISLKAIMGDMGDNIRGVEGIGEKRGYNLIREHGSVLDIIDALPLPGTQKFVQALNKSGELMERNLTLVDLPSFCGEAVAAAGQDIYDQFVKDITAIATGEV

SEQ ID NO: 493 - protein, 160 aa, Klebsiella bacteriophage F391/08
MAVDSREKGKRAEYQIRDMLRKYTSLDWERVPGSGAFGQSHSLKGDVYLPPSVGKMSQYCFEIKHYADEKFNSNILNVGESQLEKWWAQAAREGEQMNMKPALIFKKDRGQWLIALDSSDPMIDNLMSRAHFIVNKRGMEIVIGLFEPWLNACEIGDLVK

SEQ ID NO: 494 - protein, 611 aa, Klebsiella bacteriophage F391/08
MSIVINKLTISHFMSYAENVVIEFDNHRVTQLIGRNGLGKSTIGTALEELLYNKNSRGIKKDDLFNWHTGSKAYTLEGQFTKDGDVYNVKKVVKSTAKVTLTKNGEDISGHTATQTYKLIEEVLACDFTTFTKLVYQSVGSSLDFLKTTDAQRKTFLVNLFDQEQYKEVSERVKAGRKAVSAKLSGLEGSLRTAQSILSSKASLGAPQSEIPIPVFDEEPLVEELTEAKVKVALAQKQKASIAKRSSLDMAVQAAEKTFAPFENLPAPTSKSEELLSVTRNLTVVATRADDLKKRYYDFKNAAGKTQCSACGTHLDTSAAQEAMRRTKEEYDPLYKERQKLEAEVEELRKEDRAFKDYISKFNALEQARKNLKEFDEVNGTQDEIVDASGLAERIKAIESSIRQGRSSVELARTHNESVVRENAKYEAKREQIQKAEQEFDKIQAELSLVAEEVADLDILITGLKDLVGYKLEHSVKVFEEMINHYLSIMTSGKFALGFELDETKLQVVIYNDGNRTSMVNCSTGQQSRINISTLLAIRMLLSTISKVNINLLFLDEVVSYIDPDGINTLVELLQEEDQLNSIIVSHGHTHPYAHKIEVKQDEAGLSILEA

SEQ ID NO: 495 - protein, 330 aa, Klebsiella bacteriophage F391/08
MKILFSADHHIKLGAKNVPQEWQKNRFILLGEKLDEVFGATGCDLHIIGGDIMDVSDPSSEEVELLFAFLATLQHPGIIYTGNHEMKSKTISCLDHYAAAISDATDGLWKVVKDYRSPEFDIIPYSSLHKASWKPRVSDICFTHVRGAIPPHVVPEIYLERFVEHGYSKVFAGDLHSYKNSQKIGDVDLLYPGSPLTTSFHRERTKGTNGAFIIDTVLPRDHEHYLSWIELGDLPQLIRKTIEVGEPMEADAYDRVIYEVTGDVSQLKTLKNSELLDKKINNRVTKDAKLDLDDMSLLQELDTYFTNVQKLDEASRTRILKRAAEYVDSN

SEQ ID NO: 496 - protein, 257 aa, Klebsiella bacteriophage F391/08
MATKSWGSTTGGSNGDKLDYMKFNNGKNVVRIVSGVLPRYVYWIQNKEGKPAPFECLRFDREKERFIRGASDPVHDMGFKDPEKKDGKAQPLRPKKNYLAVVIDRTDNKLKLMEVKATILTGIHSIMAQLNLEDPGEIDITISKSGTGFDTKYDVQQIAAMQFQMAKNQPGSKEAALHEADVALIGEALYNEADEFEGFEKVPKLDVTYPVPSYDEQKKAIQAWLEGKKDEEGDESKGNEGSANSGNIDHEAASDLD

SEQ ID NO: 497 - protein, 117 aa, Klebsiella bacteriophage F391/08
MLFYDYEKIYILARGNSSLIVQIIRRMVEDPEAHVMLTGRSFILNEDTIVYNKRKLSDRQLAEYLGLLSFRNYAEYSFSKDTSLDMQYIPPWVPRAVIEHHPLIAINKSKLTFIEEN

SEQ ID NO: 498 - protein, 452 aa, Klebsiella bacteriophage F391/08
MKIVISNKIYCKPSNELWEYLLKHTSYQIFKPGAKYPLMFQNSGSVGKEIKWFPVTRLDLLESFGQKVTEIVDKRTLVPMDIPKPSFTLRPGDQLPIYEDCNDTCIINGKPGFGKTILALAIAHKLGQKTLVICTNTTIRAMWEKEVRKFFGIEPGVIGSGKFNIDSPIVISNIQTVNKHGAALAKEFGTVIVDEVHHCVATTFTKFLEQSSARYKIGLSGTLKRKDGLQVMFKDYFGTKVYSPPVNNTMPPTIHRFALKTQVSGNMNVPWAIRANDVYSQPEYFQQVVDLCELYSMAGHKVLFVSDRIDLIERVTNALELRGVKTYTITGVTSLDDREQVQIDVTNDGPCVLAASQSIFSEGVSLNALSCLVLGSLINNESLIEQLAGRVQRMADDKLDPILVDLKLGGVGFKQAAGREAVYRLNGWEVLDFNEKNMANLDKILFAKNPKV

SEQ ID NO: 499 - protein, 165 aa, Klebsiella bacteriophage F391/08
VLNFSLPVYALRAYDVLFQEGEYIVIQTRFTRYVLDNPSLPGTFSQRRLFLYGERENLPYKLYPLKKQFKYLSQIINSGLKHFIDSTGKIVTWKPTTYYNIITERVRGSTRIFNGKYQCYVKNVPYPFLLSEPANYISYALVRGSPVIFDTHEEEPETPRLRVKI

SEQ ID NO: 500 - protein, 856 aa, Klebsiella bacteriophage F391/08
MKIAVVDKSPNNVRYQKHFELFDHEVETFFMASEKVTGRLLKKHITIGTPENPFNPEDFDYVILVGADPFLKFAAKKGISDYSGKRVEHDGYANWIASISPAQLHFKPEMKPVFEATVESIHAILNGREKRSKAGDYRPIQCPDEAEAYVKMVYTMCPGMIAYDSETSALYCRDGYMLGISISHQEYQGVYIDADVITENTVYYLQKLFDSPEHGVVFHNLKFDMHFYCYHLGLSFDKAAEEKRLHDTMLMHYALDERRGTHGLKSLAMKYTDMGDYDFELDQFKETYCKTHKIKKEDFSYDLIPFDIMWPYAAKDTDATLRLSNFFLPKVEANPRLKSLYYDVLMPGCVFLQRMEDRGVPISKDRLKEAQVQLMTALQLAKAKLYEYPEVRKLEEDQGSVFNAASVVQLRKLLFDYVGLTPTGIMTDTGADSTGADALKELSDQHPIAKTLLEIRKISKLLSTYIEKMLISIDADGCIRTGFHIHMTTSGRLSSSGKLNLQQLPRDESVIKGCIVAPVGYRIIAWDLTTAEIYYAAVLSGDINMQQVFINMQNDPENYSDFHGSIAHMVFALPCKPTEVKKLYPALRQAAKAISFGILYGSGPAKVAASVNEALLEEHMKTGKPYTECTTGDAKEYIETYFGRFPQLKKWIDKSHAQIQTNGFIYSHFGRKRRLHNINSEDRGVQGEELRSGFNAIIQSASSDSLLLGAIDTDNEIRSLGLQDEMKIIMLVHDSVVAIVREDLVDQYNEMLIRNIQVDRGISIPGCPIGIDSDSEAGGSRDYSCGKIKKQRPSVACIEDKEFEEKVRSIIGMEDFDYAAIAANDENHPDHDKYANIKFLPEISKDIVNVRRVLGA

SEQ ID NO: 501 - protein, 294 aa, Klebsiella bacteriophage F391/08
MSRITELLDLKGIEYRDTGGDILIRCLNPDHEDAHPSLRVDPDSGVFHCLSCGFGRGIPSIFHYFNEEQYRTSPRLLRVRRMISDLRTEGRSLEIPESAMIFDQDFRGIKAETFKKYFAFQQTEDWEGRVVFPITDAVGRNLFFLGRNMDSSAPPKYMIRPKKVSPPIFPVRYNTPALILVEGIFDMLNLEDKGCHNVSCCFGTHQFSLDNIADKFMPFQIAGTTHVVIILDNDKSGNEAAKKLAKLIRDKTRIIPIIGNFLLPEGKDPGDLDAEEVDQLIRNVEILIAEHVKI

SEQ ID NO: 502 - protein, 492 aa, Klebsiella bacteriophage F391/08
MYNVQAVVLKMLLASDQKQVALETFSRLRKDHFNDAFTAIYQAVQNYYKKHNGMPSLDALMLESNRNARLSQALTVLANTQIPDVDISHAIHVLESEYTQDLFLNLLETDVLQDITILDQGELLDRVAALHMKLEERVTTTGKVFNADTMRVFKRKEDSMLNLISLGISNEFDAQLGGIARKETLLLGGWRGTGKSIICSNIQVAQYYNGDIAPYFSIEMPENEVFRRNLAIMAGVSAKAMRNDSLQGIELNKLAKTRAKMFEGGLEVYNDFVSRYTLNEMSDFHDMETMLMQERPLHTPMIIVYDPELSTATIDVELTKLTSKYGDKVTIALLDYINQVRLPDTKTLDMYDWKQQMVVSSTFKSTCQKHNVAGVAPYQIDQQGNARMARGILDSCDMAANLNAAKQNEGHDGAIKFDFVKTRNSEGMTFMPKINWNSLRMDQTSDLKLEDIRQMEAEFVIPLESDKPKDKPKRKKASDEDTNPTGESSRDL

SEQ ID NO: 503 - protein, 252 aa, Klebsiella bacteriophage F391/08
MAKLTWNEEITASLTAKANALNATVISQEAVANIAAELAAETGKEVTARSVGSKLRKEGFEVQKASDVTKSPWTPGQEDELVAFLNDHPGQYTYAEIAAAVVGGAYTAKQVQGKILSLELTAAVKPTEKAAAVRSFSPDQEAAFINAVASGASVEAIAAQFERTVKQIRGKALSLLREGRIEAMPVQEVSNAKAREDVLEGLNIADMTVAEIAEATGKSERGVKSMLSRRGISAKDHDGVAKRAKLDAKSAK

SEQ ID NO: 504 - protein, 249 aa, Klebsiella bacteriophage F391/08
MKIEIPLNCHSCGSKLDLVNDQLFCRNKSMCPAQSSKLIENFCSKMKLKGFGPQTIAKLEITKVSELFFLTKEDLVRAVGDKVATKLELELETKLRQDVDFGSVLGSLSIPLIGEVAAKKLSQLYNDFQSVKAEGKAGENLASWKNTPAGQNVINLPWKFSGAREAQVTPATESNGVVLCITGKLNDFKNRADATKYLESLGYTVKTSVTKAVNYLICEDETKIGSSSYKKAQSLGIEVLTIKILLENK

SEQ ID NO: 505 - protein, 320 aa, Klebsiella bacteriophage F391/08
MQHVKEFIKLCQDAYYKGMSIISDEEYDALIRRFPLEEEIGPKGDVPHLFRMFSLQKVYPGRGEEVPFQGIETPKLDGCAISLLYIDGKFVSALTRGNGVLGNDVTHNVKLLNIPKRISQKTPVQITGEVHITKEVENMRNFASGAINLKDSGEFLSRIAEGGLMFTAYSIQCETGKVGLTATFCGDMHILQGDGFVTCLDISSRVDWFPTDGVVVRMDGNNQFNAAGWTNKFPRGAYAIKEDDEGEVTTLERVEWQVGASGKVTPVGYFTPVVIDDAVISKATLNNVGYITALDLEIGCQIRVIRSGGVIPRIVERVYE

SEQ ID NO: 506 - protein, 91 aa, Klebsiella bacteriophage F391/08
MQKITLNAYSSPPLQGQELVLTWLEKEKGKPVVRTMSGFQMLGMWYEKNVLVCELYSPKSKRRVMSTFQAVCENFYWEGKTQMLFDYYEAK

SEQ ID NO: 507 - protein, 45 aa, Klebsiella bacteriophage F391/08
MKDHEIAQLVNKLTEAAKTYAHTQQLRAHMSRIVNEALKNAKDNA

SEQ ID NO: 508 - protein, 102 aa, Klebsiella bacteriophage F391/08
MNQNICQDYEGHIDDQSHVIFEDEGRQIRMTVSEFRGNLYFGFRLWLLDIEDNWFPTKSGFSFPYTLEMTSTLFRAFTKILSNSEVLHEVYRESQKTQASDD

SEQ ID NO: 509 - protein, 98 aa, Klebsiella bacteriophage F391/08
MNKAQVVAICEKHGEFCMQYTKLRTKGVTYLYGTTEFDPKQDKYLAERIVREGLEPADKDHILVFSRSSDKFRYIPIANIKRITSLNQELDRATPVGR

SEQ ID NO: 510 - protein, 134 aa, Klebsiella bacteriophage F391/08
MSTPTQWSPELEAELTSAYVAKIELFPEDERPGVSMEIVAEIAKEHGVSPNGLRMKLSKAGVYVKKEAGKSTAKTGGDAPKAGGRTSKSDAQAELRAAFNDAGLEDGFLDESIVDKLTGKAASHLAEAIRKITK

SEQ ID NO: 511 - protein, 72 aa, Klebsiella bacteriophage F391/08
VSKYQLLNLFQIYSEGATAIRDLHYALPMDEAEDNGWLTKYDRGLLKMYRLSPNGLVAVNQILENSVCFAAQ

SEQ ID NO: 512 - protein, 231 aa, Klebsiella bacteriophage F391/08
MAIRKKLHANSIPDEKFKEAIQWLEEGKTKKGACEILGVASNSTMERLIEEWKDNQRVSAEMRKKKRGTKIEGAELANVIDSYLSGDSFEAIAERFYRSANMIRMVLSAHGALLRVNGEVDPLFPPAIPEESMKEVFEVGEHVWVPGYQCIGEVKKALDNPVGAYRVYLLSEARQQYVNYMYWDLASVEHLVALGVDIKSLGFKWGKEDVAELVNNAVKAALKLEKRGKGE

SEQ ID NO: 513 - protein, 94 aa, Klebsiella bacteriophage F391/08
MSKRDARWETRKFPKRDTKARKAKEIELCRVIPIRLAQMPNIYDWLEAQRKTRLSIRINMELNMGYKSLSEFMHVTFDPTFYENRDCLEAKSVL

SEQ ID NO: 514 - protein, 929 aa, Klebsiella bacteriophage F391/08
MFSILEGHAGFSRDPASGNWKEVKTTDYLFAKEFSNEHPEGKPASMPYKFNVVDTVDPKNLNEAYELMVQLTQDPHLVAVRGTCLVAEKAVRRKRTNFKIDHKSNIIAMDVDGISDTGGCDRFDIVGMGRHVIKLLNSISEDMFPLNAGFIAHASSSAGIKPGIRMHMLLESNIPVTQGQLKFLFTSLNDSSRQKYGFDIADLAYYSSVQLHYFADPIFRDQFTDPFKAEGKPRLVKVNGARIELPNTMPDYEATRGEFKEEFLSLLNQIKGKRVASEKVEQTIAELEEAEDGVYLRIIPKLYHRALEDGVDFAWLEKEITSALSDYINTKDNSRSLQDYFNNGRKQALKAFVNNSMRDIPESNVKGVPVHKLTSDSPDGMNYLKINRPPPEGHLTFIKASLGTGKTTAVTKWLERDQLKGNFLAVTNTRALVSSNAKKFEAGQYDKSVDMLNFKRGAIDRMSTTIHSIHKFKNFVGQIDVIFIDECDAVMNDLLFAPVVKQRRECISVLREILLSAKVVILSDGDISAETIEAYGSLIDFDKPVSYYKHHRKMLSDAQAYEFPDESSIWVALQTSLEMGEKSILVSDCGPDELNEKGLTLRNNTGAIVKEIHSNSTSDIDIRRILDYTTNELIEQQIDCLLCSPSVTSGVDFNYFDNVFVITRTANQAPNMRFQAIRRDRGAKNIFYFIDKSTSGFSAGSEQYNIDEGWLELAQQLYVKRRELESRNFISTLRYYLLDQGATIDIFSESWGKIDSSAAEYTAERVSAILSSTPDWCAPRHADAYEAKLMLVKYFHLDSIKSITQEHAEMWISKKPHKRAEFFHKLQDIFWKDIKKCSNVTISPFIEALKKHKKDFFIRTGQSANPKYARMYLTQMGINKEMETEQIVDWYRTYCSIEGISVPYEFMTDEEKALADEAQNELGVRNEQA

SEQ ID NO: 515 - protein, 131 aa, Klebsiella bacteriophage F391/08
MSIPKMERISWADIPKELIDVAENLLRAALRDEELCFIIQHDVCVGLSKGSLAQDYEILFDWDDLSDLGLMVLVNNVVFHPSNFAAFREPGAGISPGFLVADEPWTYAPEVLREGKQNASSNSINIMGWNA

SEQ ID NO: 516 - protein, 133 aa, Klebsiella bacteriophage F391/08
MLVNEKVVNQGVGLVPWAEIPLDVKESLLDHLRVWCDNMEVYFDYDNMHLGLWVPMDEDQDEVLDWGDLTEMGLVFALGYVCLLRESYIPVGVTGVSAGIWVGRNEDYYAPENINGWIQVLRRFGFQVEGLTK

SEQ ID NO: 517 - protein, 54 aa, Klebsiella bacteriophage F391/08
MYHPDDILLWPNGSWCYRSDVQDMSHLSDDYQVLRADSEQWHEFIQMGEEYAGQ

SEQ ID NO: 518 - protein, 260 aa, Klebsiella bacteriophage F391/08
VPTFRKGAITPLWDKYKLTEVCNIQAFDKGFHYLNDPMPPLEALSEGSDDEPSRNLYELTHEFYNMRRQELGTVEPNIAHLRIAEWYERFPGQVVNFTTNVDDLLERAGIPHDDVIHAHGYLTEIMYRRGKDVIVEDIGYTAVDYRKYEWVKPAITFFGETAPWYMGQINLFDTLTTQDLVIVVGASNQVIDFNWELFPAHSRGTKVWVVNNGINYLEQSLYEERGIPVWYDTAANVFSNKHFIGQVEAWLEEKIYVPSR

SEQ ID NO: 519 - protein, 70 aa, Klebsiella bacteriophage F391/08
MKIHKTDEKRIYFMMDSGAYGSISREDVVKLLRCRNHLWKDKVDPRTSECLSEKAEQLRKEEMRNYMEFL

SEQ ID NO: 520 - protein, 609 aa, Klebsiella bacteriophage F391/08
MNELDLIDNIYSILDNEGEEDLMFNNANKASEQFPTQRDMIAGEVSKYVVAQELPAYLLAAHNRGEIHIHDMDYRAQGYTNCCLVDLAGMFKNGTKIGGAEIETPKSISTAAAVTAQVIAQVSSCQYGGTSIDRIDEVFAPYVRKSYDKHLAIGQRWLHDSKKAAVYATEMTEKEVYDACQGLEYEVNTLFNSNGQQPFVTFGFGLGESWEARMLQKAMLEVRIRGLGASGHTAVFPKLIFAVKEGLNKSPSDPNYDIKQLALTCTSKRMYPDYVSYERVTAVTGDFKFPMGCRSFLSAIESGETAGRNNLGVVSINLPLVAVESEGYFDRFWKLLDEYIDKAMAAHDWAIERLKRVRAKQAPILYMHGAFGVRLKANDLVWPIFEGRASVSLGYIGINELVEVMFEDTDPMSPPAIEFAVQVLNHMKDRCNKKAEETNLGFSLYATPSESLCNRFNTKIAEQYPEYDWLTDKGYLTNSHHLDVRTKVAPNVKFDYEANFTTIANGGNISFVELPEMRKFIPALEWVVDYGLSKSHYIGVNIPVDECEECGYLGESVSGEHGFVCPQCGSGNISVTRRVCGYLGSPGSRPFNPGKQQEVMQRVKHMNLK

SEQ ID NO: 521 - protein, 249 aa, Klebsiella bacteriophage F391/08
MRKAARRKESRRNGSAKRERHENVIPVDFEARERFQPTAKELKPKNAEQKHYISTIRNFTVTVGIGEAGTGKTFIPSVLAAQELATPGSVYEKFILVRPNEPLGKSLGMLPGDLNEKMAPWLEPIADGFKWALGERSYQGLVERKAIQYLAIEHARGRTFNNSYVIVDEAQNISVEAMKCILTRVGQDCKLVICGDVAQKDIKSDSGLQLIMDIYDQYEHVPFSLVELHDNVRSAESKAFQAIFNDMGI

SEQ ID NO: 522 - protein, 59 aa, Klebsiella bacteriophage F391/08
MITCVPLNPKHSRQSLTIWESNMVTELIIGYGEGITSEENWGFVGFGEGITSHDERPDL

SEQ ID NO: 523 - protein, 69 aa, Klebsiella bacteriophage F391/08
MNNVFTLNNFRTRKTKVHPVSLATVNKYNANYPEDERRHHAAFKIANEFPNQPLGTKELVSRMKKLHFY

SEQ ID NO: 524 - protein, 774 aa, Klebsiella bacteriophage F391/08
MTQRIEYVIKRDGTKEPFMAQKLNDWAKYIGIRSDVPWSPVAVAAVKNLPKGDVHSDDLQTMLIKSAESMIERDHRYDRFALELRLAQLRKNLFDSYTPPSLRFFHDHMVELGAWEDMSGWISDDQFEALNEVIDHSRDELFTNAGLKQFMDKYSRRNIYTEEIYETPQFAYMGMAMAMLSQPHWSMLDAIDLYNALSLQKINVPTPPLVGLRSADRGFASCCLVDGTDTLDSIDAAEHVVFKMVAARAGIGYHLESRSIADPVRKGAFPHSGKLPYYRHIDRSVKANTQQSRGGSATVYTAFFDPEIIQVMEAKSNRSPDEKKIDKMDYNLKFNSILLKRFLRKENITLMSFLYAPEVYAAFDSGDVAEFERLYIAAEKRLAGVTKRGFKGEVLPVAPVIPAAELIEFWKTVRMETGRLYTMDAGEVNRNSRYKDPVRMSNLCVEIVQPTFPIPHVVDLYRTDEELDKMDVSEYGEVSLCNLGGFALGRIKTLEEWEKISYILLKFVDTIIEIQHYPFPAMKYTALRRRNVGIGLMNAAGAMAAEGLAFEGEEARNWIHREAEKASFFLHKASVRLAKEIGPCEWFHRTHTSDGTLLIDTYKKTVDDLVSVGLEMDWESLREEIKTHGMRNSVLTASMPGESSSVLIGVTNAVEPPRSAVTIKTSGVNKVITVAPGLDDWDTMQSYKYAFDIDRTEHIKWLAVLQKFTDQAISANLYYDFNKYPGGIIPGTEIIKDLLNSTKYGIKNLYYANFDVDTGGSAAEQGCSSGGCTL

SEQ ID NO: 525 - protein, 386 aa, Klebsiella bacteriophage F391/08
MATVFNREWDHTESKLFLGQDLGIADYVNVRYPRLEELALLQRSQFWVETEISLEADKKQWPNLPQHIKNKTLLNLAWQTQADSIITRAPEDAILKLVSRPELEGMLIQWSYFENIHSRAYSNIIRNVLPNPGEFIATVQANDEAFARLALPVSVIDELAEIADIWLDARANLEIAEKEGTLEYTEEADFLALTEQVQQKILEFYYAVYALEAIMFYASFACTFALAENDILTGIAKNLQLIAKDEALHTVMAMEVLRILQNGEIPPHVVAAAQANAPKILRSILETEINWAHYIFPEGEDIPGLNADLLVEYLYYNARLAFMAINIPWPEDLPVIMEDPIGWMKGWLNTKNQQVAPQEAQITNYRVGATSQANPDDLSDEFGEFL

SEQ ID NO: 526 - protein, 187 aa, Klebsiella bacteriophage F391/08
MITALYAMRVDAAFGIFNPATMDAYGELPWGSIPEELEQFYRILDTYQVVIVGHNTYETAPPRLKKALEKKSMVYVVGSKAPVLIKNPPRNVRFITHLGSKIRDFCNEVEVVCIGGKALLETLATMGCLDAIYRSTIYPKAGTVPSLDHIMYLEHPILTSTPPDAVVTHIASGENERYRFVMEGVYL

SEQ ID NO: 527 - protein, 284 aa, Klebsiella bacteriophage F391/08
VIHYINEGKRILEEGVWLENPRTGVRCLTVIGSNFEYDVLGKKFPLITTRKAYALQAIMELIGYLRGYDSAEQFRAIGCNTWNANANENEAWLVNPNRKGTDDMGRVYGVQGRTWLRPDGSHFDQLYKIYENLRRGIDDRGEILTFWNPGEFDQGCLRPCMHTHQFSLLNGNLYLDSFQRSNDFLLGQAFNMVQCYTFLALMAQITGNRAIRANQRIVNMHIYENQYKVLMEHGQFDRKPFPAPRLEINPEIKTLEDVLTWVSKDDFKIVGYKSHDPIAYPFTA

SEQ ID NO: 528 - protein, 77 aa, Klebsiella bacteriophage F391/08
MGLFNRRPKITFSEREESQLKFLVQSSGLHIDVILGMVKYKGMDALMRQFAPKPPKENPPAKRDYNSNLLVPPAKLL

SEQ ID NO: 529 - protein, 91 aa, Klebsiella bacteriophage F391/08
MSFTDAKAMAAKAKRSNDMAVIAARRSIISNIDGSASSGKTEVDSYALNGLPIAARSQIMEDLKDAGYEVKVNHPFDQRDTESITISWGHA

SEQ ID NO: 530 - protein, 160 aa, Klebsiella bacteriophage F391/08
MFHVYTDGGCRGNTRGVDNVGAWAMVVYNSSEEQIGTKSAPKRNTTNNEMELQAVLEALLWSNKNPGRPMTIYLDSTYVKNGCESWVWGWERKGWKKADGDTPLNLDQWKWIIDELKKYRLNHNEIPTFVKVKGHSGVEGNEAADNLLNVRMTELEMEDM

SEQ ID NO: 531 - protein, 53 aa, Klebsiella bacteriophage F391/08
MLENLRRLVSEMKYEVLLMEPGVDRVVMKLRIARMEAQIFEAEWKALRGGDEL

SEQ ID NO: 532 - protein, 116 aa, Klebsiella bacteriophage F391/08
MAPDLRDLFPNVPQYQLDLYAAFLEASKSGNPLRVYRQDRRHGKSWILRWLKENEPLLKKLSERNSVQHRHTTKVGTSTSAQKSRQNISGGNRYEFIIFDDLVDENEKTQLLNAKN

SEQ ID NO: 533 - protein, 136 aa, Klebsiella bacteriophage F391/08
MAKQTSKKAVETKVATFPKTEANRKARLERHLRKHPADTQAASAVGKPAPRRKKPVTKGSTSGYVSKIVGWSTPDKADTKEVLRKTQGRFGSVKPNIFGCEYSRENVRALCYGVGIKFTGKANKPRNQKRKPAKKA

SEQ ID NO: 534 - protein, 334 aa, Klebsiella bacteriophage F391/08
MRNFVAKNDFNRAATHKSALDYSRVNSRELMDSCYEELEDWAADWPSMEENWDVSEDMTKPPPEVASKCDNTSRSNFNNKGNNMQNLQDRWISVCDIESLGTPGDCKSTFIAMPFFAFVLMKDLSLDPYIVLGTPNVAQQLALGAKVSAGTIAFWMNEARAGSAPSLSIIEALNAKDGESTVLVCNPTHESPVSKHTFMDLICPFVEAKQVIEGIIDEQGIDTRSLRHYGNGPQFDMSIYETVAAQANVFSPSDPAIVPWKFWDISSARNPRDYFEALGGDWKALVRCAEIYAHDVIERYNLIPEGVYPSKHDPVFDALVEAYCIKTIESKLKI

SEQ ID NO: 535 - protein, 153 aa, Klebsiella bacteriophage F391/08
MKAAILMISILTSFHAQAKIDAHEIECIAKNAYFEARGEGVKGMTAVAQVTKNRVNYGKFPSTYCKVVYQPGQFSWVGKKKHKLDRKDEEWKQAKEIARLVYYMDLPVDPTKGALYFHSKDTKPYWTKDKDFKRTSKIGNHVFYKLKSQLPNA

SEQ ID NO: 536 - protein, 108 aa, Klebsiella bacteriophage F391/08
MNDLSMLTKIRSDIESMVSRRSELTKAKQIISGGTQKRFTLQAGDIKFDLCGSQTRDYTFEMKPCYDMVKLGLIKALDKQIDQCTDAIKTLNVQFAAECDRLKNSIKV

SEQ ID NO: 537 - protein, 58 aa, Klebsiella bacteriophage F391/08
MVASVHTPPYERPAPNLTPEQKQLIARRTLEFKESLHKSVGRYSEQVHDLVVKTLKLY

SEQ ID NO: 538 - RNA, 73 nt, Klebsiella bacteriophage F391/08
gcuuccuuagcucagaggauagagcaacggucuucuaaaccgugggucacagguucgaauccuguagggagua

SEQ ID NO: 539 - protein, 97 aa, Klebsiella bacteriophage F391/08
MAYKIEYLKKGVLTELVIDANMARNEGTKSVFYKDGSVARMINTEDIQDLYVISDEEAGFVKDPEPAEDTPTEDTPVADTTTEEPPVEGTPEDEAAV

SEQ ID NO: 540 - RNA, 72 nt, Klebsiella bacteriophage F391/08
gggccgguagcuuaaaguuaaagcaguggccucauaagccaacgagugggaguuagagucuccccuggccca

SEQ ID NO: 541 - protein, 65 aa, Klebsiella bacteriophage F391/08
MSTKNAIVSFVDDSGIVLESTVTDISPKRLLHRDGDILEILNKRSETMLVIPVNRLLSIKIVWED

SEQ ID NO: 542 - protein, 69 aa, Klebsiella bacteriophage F391/08
MDAQLQTQYYMLLGMLEDAGPTVRGHYERHKAAFEALLKEVNENEGGKGSDSYAAFIIALQVFLINQLK

SEQ ID NO: 543 - protein, 164 aa, Klebsiella bacteriophage F391/08
MLNIKRKGFFYKWLNFSSASFTYRLNDNRVTLCSLFWHSVWYFLLQIGVTAIAVLFSLGMGSILSTFLGLTFELGITPWYMLVGLSLAGLSTIIAILLAIAGIGWACAKIGDRIQEWNASKSFERAQKEYNARDEELRFGNIYQKMRIYKKDKLCPLIRVDHGE

SEQ ID NO: 544 - RNA, 73 nt, Klebsiella bacteriophage F391/08
aagggaauagccaagugguuacggcaucggccuuugacuccgagaucgguagguucaacuccuccuucccuug

SEQ ID NO: 545 - RNA, 77 nt, Klebsiella bacteriophage F391/08
gcuccugucgucuaagcugguuaggacaccacucuuucacagugggaacacggguucgaaccccguugggaguacca

SEQ ID NO: 546 - RNA, 79 nt, Klebsiella bacteriophage F391/08
gggggaugggucugcugggaguggacaccgcacuugcaaugcgggaaucagaacgguucaaauccguuauccuccacca

SEQ ID NO: 547 - RNA, 87 nt, Klebsiella bacteriophage F391/08
ggggauguggcgaaauuggcagccgcgcuagauuuagguucuaguggugaaauauccguguggguucgacccccuccaucccuacca

SEQ ID NO: 548 - protein, 78 aa, Klebsiella bacteriophage F391/08
MNIEIMQLDRKKNEFRKVHTFPSKEALEFHIKCMGLVLPESEIFDLACANGVLYVWEITYHADPDELRKEVEQILTGE

SEQ ID NO: 549 - RNA, 85 nt, Klebsiella bacteriophage F391/08
ggagaguagugcucaugggagcaagcugacuugaaaucagucgccaucggaaacggugaggguucgauuccuuuauucuccgcca

SEQ ID NO: 550 - RNA, 86 nt, Klebsiella bacteriophage F391/08
ggaaagcuggugaaaugguagccacgcaucacugcuaaugaugaguccgcaagggcaugaagguucaaguccuucgcuuuccgcca

SEQ ID NO: 551 - RNA, 77 nt, Klebsiella bacteriophage F391/08
gggauauuaucauaacuggauaaugaccucgauuguggaucgagucuaucuugguucgaauccaagauaucccucca

SEQ ID NO: 552 - RNA, 75 nt, Klebsiella bacteriophage F391/08
gcaccauuaguuuaauggauagaauauagagcuacgaacucuaugguugagguucgauuccucgaugguguacca

SEQ ID NO: 553 - RNA, 75 nt, Klebsiella bacteriophage F391/08
ugggguauagcucaguagguagagcggaggucucugaagccuaggucacaaguucgauucuuguugccccugcca

SEQ ID NO: 554 - RNA, 77 nt, Klebsiella bacteriophage F391/08
ugcaccguagaggagaggccguccucgccagucucauaagcuggagaucgcaaguucgaaucuugccggagcaucca

SEQ ID NO: 555 - protein, 64 aa, Klebsiella bacteriophage F391/08
MMRISFTERVLGTGVMLITSWDGDSWCNVTGLRKSEQTPENIAKIKKRMAEAASRPGAPRNGKR

SEQ ID NO: 556 - protein, 59 aa, Klebsiella bacteriophage F391/08
MVNVEVTMTRYQGMLINTHTKEIVFLAPAFHDTYNEAEEDARIAKIHPDEEICVRQQEQ

SEQ ID NO: 557 - RNA, 76 nt, Klebsiella bacteriophage F391/08
gcuucaauagcucaguugguagagcaaacgaccgauaaucguuaggucacugguucgaguccaguucggaguacca

SEQ ID NO: 558 - RNA, 77 nt, Klebsiella bacteriophage F391/08
ggucaguuggcagagaugguuuaugcacucgcuucauacgugagacuacagugguucgaguccacuauugaccacca

SEQ ID NO: 559 - RNA, 76 nt, Klebsiella bacteriophage F391/08
acuugcuuagcucaaucgggagagcaucgucuuuacacggcgaggguagcugguucgaaaccagcagcaaguacca

SEQ ID NO: 560 - protein, 93 aa, Klebsiella bacteriophage F391/08
MEKITATGIESALVVDWAGWDGDHEWMVFYSCTLQPELWTRLTDEHAMPYGIIDVEIEINKLVGTIMVHRAEGDHKEIFRKSIKLVVSTGDFI

SEQ ID NO: 561 - protein, 125 aa, Klebsiella bacteriophage F391/08
MYTRPTNGNSAVVRLMIVQDNLSNNIESLDRRIEEYRTEMLSLMREREAKIEEQLEVCEAIDRLVDGTAVFMAEAPAEPTFTPVAPADMQYAILPFHLEEEDGEGPSLEDVVRFLLASGFPNGGR

SEQ ID NO: 562 - protein, 71 aa, Klebsiella bacteriophage F391/08
MDFIVVCGANTDCFELLNDALDKVDEHMQEGRTPTFIDLSQGKTYFYPSLDVEPTVLPIFMHSLSWDEEDD

SEQ ID NO: 563 - RNA, 77 nt, Klebsiella bacteriophage F391/08
gcggcuaugguguucagcggucaacauaccggccugucacgucggagccacggguucgaaucccguuagccgcgcca

SEQ ID NO: 564 - RNA, 78 nt, Klebsiella bacteriophage F391/08
gggagagaagcaguaagugguauaggcggucgccuguuaagcgaaugacagugaguucgaaucucaccucucccgcca

SEQ ID NO: 565 - RNA, 74 nt, Klebsiella bacteriophage F391/08
gcaucauuggccgagugacuaggcagaggcuugcaaacccucgaagcaugguuaaaauccaugauggugcucca

SEQ ID NO: 566 - protein, 59 aa, Klebsiella bacteriophage F391/08
MIKYKAFVTRESQTGDSSIKFEGTTLHDTFEAALTEAETHIVSKSCYAHVWEVNTILDR

SEQ ID NO: 567 - RNA, 76 nt, Klebsiella bacteriophage F391/08
agaucgcuagcucaaugguuagagcacucgccuuuuaagcgauagguuccggguucgagucccgggcggucuacca

SEQ ID NO: 568 - RNA, 78 nt, Klebsiella bacteriophage F391/08
gcaacuguagcucagcgaggugagagcacugguuugaaaguccaggggucguucguucaaaucgaaccgguugcacca

SEQ ID NO: 569 - protein, 64 aa, Klebsiella bacteriophage F391/08
MNQKILMRYNPRALWFRWEVIVSYQIRVRNGDPENNIIVLETFSNRDAAVKFLNTIDNTLIKVY

SEQ ID NO: 570 - protein, 112 aa, Klebsiella bacteriophage F391/08
MDIFTTPAINLVGVGLFQATVYRIDDSTDVVTFIVPEFFLEKFFEEFEQFREEHDAYSNMEDLAAMFPTVYGYIFEGNDLLLDKSELVELNWGISFEVGSPFPRYFQGLEIR

SEQ ID NO: 571 - protein, 49 aa, Klebsiella bacteriophage F391/08
MGGYSNFIENYINSVDSWNQETLVVVLKERFNISTLEALEAIEAYLDND

SEQ ID NO: 572 - RNA, 78 nt, Klebsiella bacteriophage F391/08
acccacuugguccaaucugguagaggcaugaggcuuaagacuucaggguucccgguucgaguccgggaguggguacca

SEQ ID NO: 573 - RNA, 77 nt, Klebsiella bacteriophage F391/08
uuccccuuagcucagucuggcagagcgggcgcuuugggagcgucaggucaaguguucaaaucacuuaggggagacca

SEQ ID NO: 574 - RNA, 76 nt, Klebsiella bacteriophage F391/08
gccucaauagcucagccgggagagcaaccgccuuguaagcgguaggucguggguucgauuccuacuuggggcacca

SEQ ID NO: 575 - RNA, 76 nt, Klebsiella bacteriophage F391/08
gcgacuaacuguacggguuacagcguccgccuuccaagcgguacugagugggguucgauucccccuagucgcucca

SEQ ID NO: 576 - protein, 33 aa, Klebsiella bacteriophage F391/08
MKAFDAELVFSLLAEMEACVDRVRALRLSMFSS

SEQ ID NO: 577 - protein, 63 aa, Klebsiella bacteriophage F391/08
MLTVKVMSPNGGEEIHDGSSVGFNPKQKSISIAGLDQHIFLKEDEVAYVMNQNGKTVSVYHGS

SEQ ID NO: 578 - RNA, 77 nt, Klebsiella bacteriophage F391/08
auuccccgaguguuacuggacagcacgccggucuccaaaaccgugcaguaggaguucgagucuccugggguuugcca

SEQ ID NO: 579 - protein, 118 aa, Klebsiella bacteriophage F391/08
MITYSTNFMGPVSNNWYIRMGIPYTEVTEPNRFADGGQLTRKVFAKRYAGGRIDVRGTDDYFGQEIGVPIMEAESWNELQQFLWTFSSDKVLTLEQIVQALEDETGFRIVWFKEPACT

SEQ ID NO: 580 - protein, 126 aa, Klebsiella bacteriophage F391/08
MYIDRNQLFKFLELDLRWPLSVNPGRATGKTFEAINTAYEFAVFKGIQAVYVASGVREMARLEKKYNELQPHVKITTYSMLEPYRIGRRFSCIMFDEPSLAIKYGVNAYVVRIARENQCPVIIFGE

SEQ ID NO: 581 - protein, 58 aa, Klebsiella bacteriophage F391/08
VEQEFQVFVDASKRVLFIQATDEGHGLQLSFDSLEQINQIVLRAQKSLEKNTEAPPDL

SEQ ID NO: 582 - protein, 71 aa, Klebsiella bacteriophage F391/08
MREISKMKVTMENTEEFIAICTAYADTLPPEGMDDHTMQLVADIYRLAELAKEQHNRLVYVKERLEMMDKE

SEQ ID NO: 583 - protein, 90 aa, Klebsiella bacteriophage F391/08
MNELNELNELHYAERAIDELDFAGGYYTRHVNAMTAEGLNSKSAIAAELAVRDFVIDSLQKTISNLSENNKAALEALDKLSNHLLALGIK

SEQ ID NO: 584 - protein, 180 aa, Klebsiella bacteriophage F391/08
MNKQSLRGIRVFRSSLVDSFYIWGKATRRTVEQALDGTFYDWREKERNPVFSRPGLYHDRVSKTAWYEIEVTPGVIRAFYTDWEHEKWVWDNQIAPGDRIMNYAEYKEMKRMFELYDVPRLSRPAIFIASQEYWHTVRMKRDFNKHHLRYEKEHGTLRERVAKRKAELREKRLEKKYGES

SEQ ID NO: 585 - protein, 75 aa, Klebsiella bacteriophage F391/08
MVKASLLRFTPGVGLQYKIVGGHKFQYFTPGKLYFVELHDSRAGYKLRSDANEGIWVSFTQVKRWFTVEGYNDYE

SEQ ID NO: 586 - protein, 122 aa, Klebsiella bacteriophage F391/08
MIMSKVVYFVKCCRDTLELVDHKMQTCKCGASSIDGVAGAYVRFLGDKSNFMRLNEFQLEVEKNRPALEAEAERLKDFDGNIVAYNMVSGKDFWSELAEKLNMPRQAAKALYHGFNYSPRWN

SEQ ID NO: 587 - protein, 88 aa, Klebsiella bacteriophage F391/08
MASTTRHVGIKFSNSNRTYVYRVPSYWKYSPEIGDVVVIPGNVMFNNPRRAKVVEVHGMYGKPEYKERKNISYVELHDYLPKEERNGR

SEQ ID NO: 588 - protein, 101 aa, Klebsiella bacteriophage F391/08
MDDKIAREAIELVRKRLEERNVEVPKIMLIGYGGIGGFPSFTDLERMERESQASFLELESYAREMEHEHPIGNNFMPRSSRQEVTHGKTNSWPTPKRRGRK

SEQ ID NO: 589 - protein, 69 aa, Klebsiella bacteriophage F391/08
MITTGFGYSHEELCKMVESAPFIKKLVEEQRPVCLHAACTKCHGTGVDKNGKMCVHALSCPCPKCSWSC

SEQ ID NO: 590 - protein, 145 aa, Klebsiella bacteriophage F391/08
MDLGYCVVHEFMEQGLPDRICVVTSRNLEAAQSLVERLSGYYRDHERYQQKVFDLTKLYHQKALDMPTPQLDDLKQFSPEAWYSVKDASPVDYTVQVFSHYGTRHWINRKWDSMVDYLNSELEKGAAEYKRKRAEAKVLKNSVAL

SEQ ID NO: 591 - protein, 107 aa, Klebsiella bacteriophage F391/08
MSKLSIESIIRPLMHGYVQGSCVSETEALNVIEEELVANGYNLHEGVIEDLFWQTAEDMEIFRCVNCGWWCPAFERAENQIEEICRDCEPDLEGEVDEQDNEGEDYE

SEQ ID NO: 592 - protein, 99 aa, Klebsiella bacteriophage F391/08
MNKITKVKTMSKRSIAAIIAFSMMYSGVSLAAERNKVEISDNGRVRVTTNGITKGAGKFRKSETRFGETKIYTNKTYGKPAVTLDRYGRQVEDEDDSDE

SEQ ID NO: 593 - protein, 144 aa, Klebsiella bacteriophage F391/08
MSNLHPKLQETLDWINEECAFEEAPYCVWARAGAAPSEWCTVFDNRYRITVELSLKEDKVYAKASMTALGLSGFVEMQELCMPNTHLRVQIEQLATIRLMLPEDNINDHFHKVIENEYKLRRQRRKARREVEKTRMMCNMNPHV

SEQ ID NO: 594 - protein, 130 aa, Klebsiella bacteriophage F391/08
MFTLFILAVSAWMAVGINHGLDSAKLLSAKAFEFLAKFATRKDIEAIIAKGGAKDASSVLKSFDKILELRNGKHAAELRCMSRKTIGRLCKAIFIVQGALKGPFAKYKPDSIKRAKIFNDYCVEHHPLNR

SEQ ID NO: 595 - protein, 232 aa, Klebsiella bacteriophage F391/08
MRIISKLKDVYDLQGTMYDAERAWYREEVKEVVNVSADFEQIIFYAEILRNRTSSGYGGVNMGTLEVRPVLICGTLRWLYGYHTGLGADAVHIQTFDPVKVKEVLEEQGYYLRMGWDMNTIEKIDAHVRNATATASAFLETFNKPIAMAWDAAKSKTDPTVNITVKTDFNFHAEDFPWQEIDPNLYRWHQTLESYIFGVLGQGEPKTESTSDRDRLIAKGFDAKVSFRNMER

SEQ ID NO: 596 - protein, 153 aa, Klebsiella bacteriophage F391/08
MLKFLSGIWSGKTGAILFLAIAAGTFGGAYYITNKLTDMSSSLQSLSNRNEQLEKTVGNLQTEIRNRDRNTTTYITNLAKNQEDLDGRINKLDAARAKEGVVAAKPKLATKVAKDKVNEFQERLSCVTGNMDSCSRLQLSHPGVQNGQTQVAQ

SEQ ID NO: 597 - protein, 109 aa, Klebsiella bacteriophage F391/08
MRNWKYGLLLSAAIIASGCAERPDPSSTVTGVEPQHLPWPASLQTCPFNFEFINEEGKVYVRIPYQDWITMGKCNEQVYTYIANLTALTCTYRVSLNEYRCKPFNKETK

SEQ ID NO: 598 - protein, 253 aa, Klebsiella bacteriophage F391/08
MKYVLGLIGDAGAGKDTFADMAKVWAWEVLGPEYSISKFSFAAPVYELAAVILGVTPEKLAERRTKEIKQWFWVTQEALERTANVWKRFGIDKYADFSYVWPQFEASALYPLIAKTAPDFYQGRETPLYPLYTSPRKMLEFVGTELGRALVDENLWLNIVVDRITATKADISIISDVRFDNEAALVRNFPGAQNSSILKVHAPNNIHAIQSTHASARGVAPEFIDDVVTNNFDGLENFRKNVNAFCDERILFI

SEQ ID NO: 599 - protein, 203 aa, Klebsiella bacteriophage F391/08
MGQINNVEQKGGNKTPNYFASLVATKAEYNIYHYHLDGPIVDVDYYRDLSVTLATMQEGDTLNLYINSPGGYVDTAVQLCNLIMNCQGTVIGHLVGPSASAACSIFLACHGWLVHPYVMLMGHTYRGAHYGKGKNEIQHYADQFNSFFEDMMLDLYYPFFSLEEITEMIEGGKDIWLTSKEINERVDRMAAHREQEARKAAGQ

SEQ ID NO: 600 - protein, 220 aa, Klebsiella bacteriophage F391/08
MDKFIQLISLLLQEAKDPASLLKRLLTLLVGLVIYLFIANTSEVMSYLKTFSTSAVLQDVKVQRTLEFPNVAREKAMILFSQTRADAVFVVKYKPEAINDYQTIIAWESNVQLDKSDVSDKAVDKTSMLYRAHLDGLNFAIDAREKRGLSKWSGTGLPPFKSANFEYVYTCPYFNLNNIYSGYVAVAWEKYPLQDEDMGMFNDYMAKICASPQRSLGRSI

SEQ ID NO: 601 - protein, 137 aa, Klebsiella bacteriophage F391/08
MSFRFGNRSLQQLDTVDPKLKALAIRALELSPHDFTIIQGKRTVQQSAQNIANGTSFLKDPSKSKHVTGKAIDFAPYINGKIDWNDLEAFWAIVGAFKKAANEMNIAVRFGADWNNSGDYRDEIQRGTYDGGHVELL

SEQ ID NO: 602 - protein, 134 aa, Klebsiella bacteriophage F391/08
MSDRFYTQMCEHFKVSPYELNIALWDRESPEFKKIAKKSEGVMSNGKKMTRIDLNNALTKLLGVNIEGQKLSMPTLTTILEKVKAGDVKKVAVPEGRLKKPYQEAIIEAFGEKLDLDTATVKTMKALLESINNV

SEQ ID NO: 603 - protein, 94 aa, Klebsiella bacteriophage F391/08
MSKKIVFLKGSSCVPCKQFEPVFDKLTAEFNLPVEKRTDDVDSLRKFGLRTVPAVVLVDVENGREEAHHILSGATLRSAVVSKAIQDFIDYVEE

SEQ ID NO: 604 - protein, 134 aa, Klebsiella bacteriophage F391/08
MTKQAYLILNNGFAVGTTFVDLGYTKEEWQALDAAQKNQLVNEAAWEYAEAYVEAVDDELVIVVSLGAVGCDAHVHTDFQSEEEWDELDLTHQNALINEAFWEVVDCYVAFCKDDDEANTCTNYGYEHDDVECA

SEQ ID NO: 605 - protein, 120 aa, Klebsiella bacteriophage F391/08
MQKFSRDWSSDMARKNRAAAYYNKKIQLDKLIKGITYNVERGFSGIKVDARSLDYSCILWAKQNGYAFKRIGNEILIAWEPEGLVQYVIYDPYRGEYVRDHRQQPTDFSLPKRYYLETRY

SEQ ID NO: 606 - protein, 276 aa, Klebsiella bacteriophage F391/08
MNVHETVTVPDNANIFFIGDIHGEYDMMMGALKLAGYEEGRDYVFCVGDLIDRGPKNLQVLAKFLYNPKFRSVRGNHDEFMIQDDYANWMYNGGSWTITEGFDTDTMKGIAEDMDSKMPYIMTVEHRGKRYGVVHAGIPLRYQAQGMGVTVPVWDDIVHEHESTPDLRRLGVLLWDRDVIQEVGFNLYRSGEKHPYFDRYASFSEECAVDVPEIVGVDYTFHGHTGVPFPIRWKNRVYLDTGGTFNGRMTVASPVLGQLYTFTTDRDDPCGSADII

SEQ ID NO: 607 - protein, 77 aa, Klebsiella bacteriophage F391/08
MKLFKDLEEGEVFVVAGGFELQKCVAMLDNGNSVFTDDANISVTIAPDTETWKPKEFWEIHKDRPLDDLLDDILFTA

SEQ ID NO: 608 - protein, 122 aa, Klebsiella bacteriophage F391/08
MKLESRYIVFKQSDAAKYLTSTAIREINDSLSLIYKGREADGKVGFPNYIVLEEDWPEYPIAKEALEGRIVLEEFNKRAEKKRGAKAAEDHYKQHQSTELLRGISPFCAGWNDYMRRLVIEE

SEQ ID NO: 609 - protein, 39 aa, Klebsiella bacteriophage F391/08
MYTGMGNDMAKMFIGLLILAALVGAAIVGGIWALVAFVF

SEQ ID NO: 610 - protein, 142 aa, Klebsiella bacteriophage F391/08
MKNAMIELNANMESLRHAVNTARASFNLLMRDESIPLSARVKAFEEFADELLHMGDYLSDSPFNEDRRDYQHAYCNRGEIVYLTDVLESVLEYANSFMRTPDEWEDASNDYVLDEIQKNWPEIKKLVEEHIHSEVYAYRIDW

SEQ ID NO: 611 - protein, 101 aa, Klebsiella bacteriophage F391/08
MAKNTISYTTGKTADEQANTLTKDEMVAVLVILLDMSGFEGQLAKLSLPALRALYEGTNKNAAAYNLAKNEARWAKEHQQVAERRAESFERDLKREKAKKK

SEQ ID NO: 612 - protein, 93 aa, Klebsiella bacteriophage F391/08
MVLEILSGLLIAALVTGTGLAVWVSILRENNRRMRLTNNGLHEKLMDQVQDADEFSAAAERLLVRLAKIEEIIGQDSTMSKTTKMRLITEIKK

SEQ ID NO: 613 - protein, 82 aa, Klebsiella bacteriophage F391/08
MISPIVAALYLVVVGYLSGKYHGFGLKGTIKAAMLVPLYPLAILLTGYYACVLRIFGRGKVNYDNCTALLDDIENTIKKEEK

SEQ ID NO: 614 - protein, 113 aa, Klebsiella bacteriophage F391/08
MNLNSKERQVLVDALRQVVDHDLLCDEDIVESIALIAKIELAEKDSWRPLSELPPLGLAIVVQRADGAPFNTVMVRRDLAKSYSPDIITLHTKITNEPFEFNTRHYYWRLTNA

SEQ ID NO: 615 - protein, 75 aa, Klebsiella bacteriophage F391/08
MLNQLRIYNFLDCNFQVWRELPSRFLGWALFLSMVVSVFHNVPATFYMEAIQPVTVFIYEMYLVAINGWKDGRIN

SEQ ID NO: 616 - protein, 155 aa, Klebsiella bacteriophage F391/08
MAASTEVLNQYFNREHQEFSDLFIQMFVNANNALDYRFFNEFHETTFSHQDINSALKELIGSKVIPFRQTANAETLELSVVWGLFKKAYEFGKYQNARHWIYEVYLNTEVILPRQMMLGWIAKQRPERNAKSFAPINDGNLYHASEKFDAPKSVA

SEQ ID NO: 617 - protein, 108 aa, Klebsiella bacteriophage F391/08
MLLVEGLTEEDICLNSFYNCKTHVMQALDEERVELSKFMVNIATAQVHWQTQGLSADDILKHTLNAIAEYGKARGEALLASKKEFDKSESMLKMAIDIHMEGIDGTIH

SEQ ID NO: 618 - protein, 95 aa, Klebsiella bacteriophage F391/08
MAKKRVVVNFLEEDSGDCEYGCWNTGYGVEVMVDGKCVHRQEAWASCTNNSSVDFDVLAHVLQGIKTKEGYPVKADHIDFGDPSDYPEEFLDLFT

SEQ ID NO: 619 - protein, 62 aa, Klebsiella bacteriophage F391/08
MKSIDNYLRGENPVDQAAVTVEKVRKECFILTQRGGGNRPNRVYLNWTQSKDLYERLKREFE

SEQ ID NO: 620 - protein, 158 aa, Klebsiella bacteriophage F391/08
VEELRQKINQELVWEAKSFPINQFLKRDGSINHNKIKQLRPDFRQDAKNLIFINRALDAHGVFFGYEKLVFHSLNQLVEIWCPDHQDYFMQTARSHLEGNGCQKCRHRMVTRVTDYGSYTVPAYYHKFSIDGDSIIWYNNSSKLIKPLEVKDEIRFPE

SEQ ID NO: 621 - protein, 133 aa, Klebsiella bacteriophage F391/08
MKYDSLNNPSTNYLTDQSVSEIKFHPNYSPDSSKPSVAAISFRFRNLRFTFVGEEDKMISIIDKVKAVSELSGSDTVKFEALTSLLLTSGATVGKFELIQPHVSALTNTRNFWDQANVESLIKWDSATEFYNK

SEQ ID NO: 622 - protein, 169 aa, Klebsiella bacteriophage F391/08
MLFCTVDFEEANETYIVYGMSESKVRILWNQFQLEVPDDISKTPKDFFHLIDIKAVKARKKLTPYVFPGAVFVHELTAYTNVVLKKSRQHPGYLTMLTYKVGAIHDGELVVRVDARLQQEVEEMIRQCQNKAELKQRARLFDMAAPSEAVAAYHGFYKEIAESDEDFFM

SEQ ID NO: 623 - protein, 106 aa, Klebsiella bacteriophage F391/08
MNEKYEVWTPVGENCSYLLRTLCTREDGTSFSEYLSECHAKAQQDNPLFKIRGEDILKVNGVPYTPVDSFAALQVFKEHREREHRRMIERLTGREPFSHPRWNEET

SEQ ID NO: 624 - protein, 254 aa, Klebsiella bacteriophage F391/08
MSRVEKLQHIYNLVKKADQKKLSELSEEEYQAVLFCCSAMPAKLDGVLAKSDIHNGKETTFQPPYKWLASNIQQMVGKVTGFSNRKTPNIFIDITPRTPEFTKDWRDALDSFPSWKVFYKPDDETYAHLPFLKHPGYTVEDPSSGVNFKDFKCTDENIAYGLMRTSVRIAMDHELDKQDLAVIALCKDRYIKVKRIAEKLSVLSCFETIRDCEPEGEYPKGSLYWKDVKHLGLSEEAVFLGLVVTGRFLRLQEK

SEQ ID NO: 625 - protein, 109 aa, Klebsiella bacteriophage F391/08
VGYSRDPFYRLNSLQLHRLPHRGLQDIVIHSVYIIDDASEFSAKLLEKAAHKKFKPMRVNFGDKFDGHTEWFDVEPHVIEKFFLSVGAKQVPIDKLIAQEQKIRKSTKK

SEQ ID NO: 626 - protein, 56 aa, Klebsiella bacteriophage F391/08
MRTLRGGSPKSRSHNTYQLNVIRDGQKKGGDGGGGEWGFRVIMVIIMTLVFLQSCQ

SEQ ID NO: 627 - protein, 321 aa, Klebsiella bacteriophage F391/08
MLQKFTPVANLPMVRGGARNLLDGSKCASIGHILGVYRSNMESRTSRAFEHSRDYVLANPGAAIVIFHDDQYLVDSQPIDLIVSTTTDAYLYKASEGKQASRRFCYHESELLAFTDARAWIKNLCDHLELPPARISSEMMIFVLDKDGSILLPCDPYDIDIEEGARTGNYRYDGELEEVAPAVTENVVNPNNFETGALQMNTIKSTATAIVAANKNAAVNAAKLEAGSIVLKKVSGIAASKAPFMVRGYVDTAVGRVVIANLLNFAVSQYAPNNRKAVIAADAAMQAAMLELVQSFNVGEMIDEVLKGVNLSSLIESDVAE

SEQ ID NO: 628 - protein, 164 aa, Klebsiella bacteriophage F391/08
MERLTATFEGEKMTIANVWQRLRQNGDRGNFAIFIEPKNLDNLARQIDRRDCYPDTDDMLGIPLRIIGVYGYGFDICIGDSSFEIDCESGATEIEVFLINLGSLTFLDTPPAEPEPEKLEVKTSVIVSSLTMDELADIVSTYDEIHADAIKELNNRLDTFRDKL

SEQ ID NO: 629 - protein, 175 aa, Klebsiella bacteriophage F391/08
MFHVKSCVPGINYTVEAEEGLYLEGGRIESQEVAAVLKCDTNVCGTSWTDLHFLGRGIDVDSLSWEKACEHAESMLNEDDWDDDDSDEKYANAGVEGSFYMYWPGHSCNLVNGGSPLHSVLERAIYLGYIQIVDGKAVINLRELKTFIYIPDAETILHIEEGLKSGWKVSGVVYL

SEQ ID NO: 630 - protein, 115 aa, Klebsiella bacteriophage F391/08
MIYIYVNKYFLAHYKTMESVIQYVSRQNARHIDEVATLKIGLRGDAINISWPLLILICRDLVAGKPVSVSALGESYPLSDDLDLYDLLTKYKTERLFYRGGSVCSSGETIETVFR

SEQ ID NO: 631 - protein, 44 aa, Klebsiella bacteriophage F391/08
MLKENVMSSEIVNEFTVADAEHFIETYLNVYDVDLAFIHKDGQI

SEQ ID NO: 632 - DNA, 14141 bp, Pseudomonas bacteriophage F83/13
ctccagcctgttacgaaattttttgtaagatcgtgaacaaaacctcggtgccacccggcgcaaacccgcgtggcactaaggctccagcgtgtcacgaaattttttatgtactttccgtcactctgtgaccagatcctccatttcagtcatccacaggagcctggaaatgcgcgtccgcgacgttctggtattcgctttttgcgtcctcttcgccttcgccaccatgacggtcttcgtctatgcccccgccaaaggccaggaaagcgcatttcgaggcgtgttcggcccagggtggggtgttggtatacacccagcccgaaacccctcctatgcgtgaaatctgacgccctcctgcccatccctaactactaggagatcacccatgttcgtcgacgctctggccttcggtttcatggctgccatcggcatcttcattctgctgtggcgtctgcctcgcatcctcgtcctgcatctgctgggcatgggtttcctgctcgacacggcgttcaccaccctggtgttctggatgcactggggcacggctatcggcatgttcgtcgccacgatcggcggcctgttcggatcggccggcatcagtctggccaaaggcgtgcttggctcgatcgacttcaagaccaagcagtacaaagctggttggttcggtgaccgtcgtccgcccgagtacaagaccactccaccggccaactgagcattcgcttacccactcacccactcacccgcccacccttcccacgaccaaaccctcattgccaggagcacgccatgccgacctttgccgattaccccatgcctaccaagcacaaacgcctgcacaccaaagtcgaggtatcgaaagcattcgaagccgatctggacgaccgcctcccggaagtgagtgccttggccgtgaccagaacctatgcagactatggactgcgtggcacgtccagctacgactcgtacgtgagcgatttcatcttcgacaagtccaatgcttccgacgctgttccgcatatcggctcgaaggctcaactcgccaaagccaggacgcagtaccatgccttgttcgacaagcatgtattcaacctggctttggttcgtcgcaaccccaaccccggcacccccactgaaacctcccaggagccaactcgaccggcttatgtgctacggccggttcaccaactgcttcttcgatgactgcttcttccagaacatccccatagtcgatgcgacgttcacgaactgtgttttctttggcggttcgttcatcaggtgcgtcggttaccgtaccaagttcatcaactgtattttcctcggtacgtgtttccacgaaggcacgtgggcgaacgccaaattcaacggctgtaaaatgtacgaagtacgtttccgcctatcgatagatcccttccccatgccggagatacagctcaactacgtttccttctacatgtcgaaacttgtaggcgtgaccttcgaaggcgacgtgttctacgacaccgttttcccggcgtcctacctgatcggtgtggccctgcaagatgtcgatctgacgaacgtggatatgcgcaccgcgttccacgtcgatatcgaaagcatgcgcggatgcaggctcagccgaccgaacccgacacagttcatgtcgctgaacatccacgactacccgatcatctacaccacgaatgtcatacagatcggttgccaagcgttcagcatgcaggaactacaccgttgcctgagcatggaaacgcaggagctgtatcagctgtcttccgatgcgccggaattggccaaagcccacctgaagtggctgctcaagaccatcgagcgcttcaaacccaagccgctcccgtacgagtgctgaacgatgaaccctcccaagcgttatcgccccgatgcggggttcgagcgccgtgcatggcgtcccgacaactacctgctagaccacccgcggttggaatggaacccgtacaccaaacagcgtccgtgcagggacttcgattcgactcagctgatactggtccagatgtccgtcatggatcactcacgcgaaatcatcaagcgcatcatgtgcgctgcacaggagtagcaccgtgctgatagtccacgcccacctcgacccgcgtcacaaaagtcccaagcccatcactccgcccgatccgctgccctatgtgagccggcgggcgctggcacgtgtccgtgagtgggttccgccgccggatgtgtgcccgaactgcggcagcgaagtgaacctggtcaataacatcgagatttaccgcagccgatcgtacggggaatggccctacgcgtatcgttgcgtgaacgatcgctgtgacagcttcgtcggtctgcacaagcacaccgacctgccgctgggcacgctggccaccaaagccatgcgtgacgcgcgaaaggacgcgaaagcagtcttccacgacctgatggatcaatggtccggcgtcttcaaccgctcggaaatgtacacctggctggccaagcagctgggtatcccgaaagcgcactgccacttcggaatgttcgatgtcccgacgtgtcgtcgcgcgctgcaaatctgcctcgcagaactgaaggaacggaacaaatttggaaaacacacaaccttttgagatcaccgcccatgagcaattccaccaccagcaccaccagcaccaccatcctccccgatgatgtcgccgccgtaacccctggctccatcccgatgtcctattaccgcctgctggccctacgcgcacaactgcgcatccaggccgccggcatgaagacccgtagcggctcgatccgcaagaagatcgctgccgaactcggactcaagcccagggacagctacgaagtcttcatctctcgcatcaacgagctgatcgaggaagccaagctgcgcgccgggcaacgcgccggtgtgctacccaaggattgatcggagaacgtaatgctcgccaagaaacgcgaccgaatcctcgccaaccagaccccgcatgcacggaaggtctacgagtgcgtaccgatagctgaaccctggccggcgcaccagatcatggcgcagttgaaagtcgatcgtggctctgcgttgagcgtcgcggtggtacgcggctgcttgaaggcactgcatgaagctgggctgatccgccggccgaccagcgatctgtacatccgcgaaaaggtgactgaatcggcaactgccacaatcactgagctgatgaatgaaaccgtcgccgattacaaggaccgcacgaaacaggtccagccaacccagccagcccagcaaacccagtcgaaggaacctagtatgtccacctcgatcgacgccctgctgaaaatcgcacagcagctttctgtcctggccgccgaagtcgaagaaaagctgtcggagatcgcatccgagatcgagacggcggccaagcaggtcgagtccaccaccgcaaccgatcgtgagcaactggccaagctcaagcagctccagtcccttctgaaggatctgtgaccatgatcaagaccagaaaagagccgcgcagggatctcgaagacatccgccgcagacacgaagagtacatcgccgcacacaaggccagcggcggtgtgactcaggtctatcgatgtccgttctgtgcacagcagatcgagactacatcgccgactaccaagcacgacatgtgggacaccatgacgagctgtccctggtgtgacgggctgcatttcaagcgcgtgtatttcacgcacgtcgaggcaagagcatgagcatgaacgaaccccgcaattggttgaatcactacaactgcccgtgtggttgcgaatggtcggatgaatggtcctgccaatgcgacgacgaatgtccggcgtgcggtaccgcttgcagcccgaccaaatccgaatggatcggtaccgaacttcccaacccttccatcgacgagaagatgcgcctgcggcactactacgggtggatgcgcttgcgtttcaacgccgacggcaccgtcgacgggcaggaaggggtcgagctgggggcgtgctgcttaccagccggcagtggatggaaacgttggtgctgtggcgccaggagaaacgagcatgatcaccacgatctaccacgtaaccgtcgatgtacctgattcggtctggaagcatttccgcaacgaccagatttatttctgcgaggtatgcgaggcgttcaaaggaaacgtaaggtccggcaccaaccattacggtcaggttgaagaatgggccgacttccatgattcctctgccgccgtcgccgcggaagcgaaagccaaggcactgatggtgaagtacgaacacctcgccaaggtacttgaggaacaagctgaagagggatacgagggtgaccactaagcctacccctcagaagatcaccatcgaaggtgatattgccacgaacgtacgcaagcgcgggtatcggttcgtacgccgcttcggttccatatcgactcccgacgacgaaggttcgtcatccaccaccacgtggccagtgctgctctggcagcacgctgtcctacccggaccgattcgctgtgtcgtacggtgccgatcttacctattgcctggactgggtacaggctgccgaacgactcggtgctgccctgctccatgccacaactgtcgacgggaaaatcaacgatgactagcagcagacaactcaagttcggttcgtacatttccggcaccatgcgcacgcaggatctggtgccgaagttcttcgagatcctgatgtcggtatcgacgaacgccgcgtaccagatcgtgctgaccagggcatttgaggacgacatttcgctggtcgaccattggctcttcgaaactctcacagggcacaaaaactaggccgtatagcgatgccaattggtggtcctctgtcgaagctgcggaaatggtcgatatgctgatcaacgcacttcaggacttcgtgccggtaggccactacttcggtgcgcaccctggcgacggttcggacttcggctgctggcgcttcgaggactcgcatctgttcaccgtgttcgtacgccagcgtaacgatgaaggcaccacgtacgtcgagtcggtatggacgagtaacgccaccgaagccaccgagataatcctcgccaactgcgccaatgagtggaaatgccccgcatcggaactgcgcgcgctgggcatcatcgccagcgaggcagaaatcgaaatcgttgagtggaacgacgaggaataaaccgtggacgacatccaagttcggctagccaagtacaaagaccgtaaagaagaatctcgatacttcaaaaccttcttctataactatgacttcggcttcggctgcccgaacggcgttcgcgcctctgaccgcggtgagttcacgacctgggtcgaaccctcgcttcgattcgtaggtaacgcggatagcttggtgcgcatcgggcaccgaggctggtacgtcgacctgtctcagcacgatgttgcatatgggcaggtataccggcttccggccaggaacggcgaagaacgcttcctggccgcctacgtctacagctacgacaccgactgcgtgacgttcgatatcaccgaggtgttcgacgacaaacgagaagcagccctggccgccgatgaaatggccaggatcgccgccgagcatagtcgcgaagctgatcaggaagacgaaatccaccggcaaaaagaagaggcgcgtgaactacgcgctgaggtacgcacgcgcatgcgtgcggtaatcgccggactgcgttggaagcgtcacgcagctaggatgatgtcgccggtctacatcccggacatcttcaacgtgctggccgtggaagaactgagccgcgggttcgaagcacgcgctgagctgtacaagctctggaagaacggaaccgacaacctgtaatccgcaacatcacactacgaggaacaccgtaatgcacgacttcatcatcaccctgaacatgtacagcttgtgccgccaactctcggcagcttctggcgcagaaaaaggatatgcgtctcaactgatggaccttcttcgtgtcaacaagctgagcgacctcgacaacaagtacgaagcagtgaatttccgtatgtctgccgagcagttcggccagttcatctaccttcgtgcggccgccggcgctaacaacgggatcaaagaacttcgaatcgaacgcatcctgtccggctctacctacaggttcaacgtgttccgcgatttgacgaaaaacgtgccgaacgaatcgccctcggctgcaccgactgcgccggcacagatggacaatgcgatatctgtggctgtcgatatcggcatggccgccaccgggagcgcatcggcgtctaccggtggtatgagccactacgcagcggagatcgataagctgcgtgccctggcttcgaaggtcgaagacgcacagatcgtatcgatctgcggcggcatcgaagtggatcgtgtcagcgcactggatctgatgtacgacgaaatccacaagcgtgaacaggctatcgccagcatgttcacttccaaccgtcaacagtaaggaccatcaccatgggtagtcacgttgcaatggcgcattacctcgaccccattacgggcgaaaagcacaacgagcacatcctgctcgataggcaactgaaagacaggctaccggaccatccggtagctatcggtttcgagctgaacgacgaacacaagaagctgcatgctgacggctacatcgccctggtcgccatcgaccgtgcgaaatctctcggcagcagaccgcaggatgtgtatcgcctgggcactcacatgcacgttcgccgtgaagcgctcaagcgcatcctgaacatcagtgacgcggatctggcactgccgttgatttgggtcgatgtggaaatcattgacaccatcaaggcaatggctggtatcgaagaggggaatgccagtgcagaagaagccgaataaggacgcggcactgaatgtgctggagttcatcgccaacgaagctctcgaagcgattgccaagttcgaagcagtgcagagcgacgacaacatgtcggaactcttcgctactcgaatgcgcttgaaggtgcaactcgacgagctgaaagcagcgcgtggcgaatcactcaccaacgatctgtacctcaacggatcgttgcgtgatgtgaagtcaccggagctgctgatgctcaagcgcggcgaaatcgagtccatcgagtacatcaagcgccgggcgacgatcctgcgcaagaagctcggtatctcccactacaacgcactggagttcctggcgcgcgaagctggtttcgattcgtaccgccacgcgctccgagagttggagtacggcaagtgaccaccccgttcaacgacgattttatcgtcatcgaatacgaacccgacgagacgaaaggcgaacttgcggagtacctgtacggtcccgcgacgtacgacttcgctctgcccgtagagtgggtcaagcgtgccgaagctatcaccggccagcaggtagtaccgcacttcgtgtggttgtacccgccgggcgatatagctggcatgcctgcgccactcaccctcaccggcgtgcatatcctgatgcagttagcgcgctacccgtaaaccgcccacccactcaaccgcccaatcattcatttctctacgcaaggaacatcggatatgtcgaacaacgccaccgtcaagaaagctgtcaagtcgctcagcgagatccccgagcagcaccacgtcgccgagatcgtccaccacggcgacaagctgaccctgcccgaaggcatgggcgtcagtgatgccatcgagctgctggagcgccgccgcagctacctcgaagaagctgtcggcctgacgcgtgtcttcaacgtcttcccttgggacggcgcgaacgccatcaacatcgccctggcacgtcgtttcggctgggccgccgccgaggctacccctggcttcttcggcagcactccgccgaagatgatcaccatcgaagtcggccctggccagacccgtcgtgtaccgtggggccgctttagcatgccgggtatcgatggttacgtgggaaccagcgccagcatgaaagacggccgtctgtgcttccagctggtcgcggaggttcggcgtaaggacgaacagaccatcgagaagctgttcgatgaagtcgaagacgtgctgaagcacgaatcgatctacgccggcaaggcgatcaagatccgcttccgggacgacgacggcaacaccctggaaatgcccgagccgaagttcctcgacgtgagcggcgtgtcgcgcgacatgctggtgtactcgaaagaagtcaccgactccatcgaaaccaacctgttcacgcccatcgagcgcgttcacgactgcatcaagaacggtattccggtcaagcgcggcgtcctgctgggcggtccgtacggcaccggtaagaccctggccgccaccgttgcctcgcgtctcgctgtcgacgctggcgtaacctacctgtacgtgccgcgtgcggacgagctggccgacgccatcgagttcgccaagcagtaccaagacgtggcctgcgtgatcttctgcgaggacatcgaccgctgcatgagcggcgagcgttcggtggcgatggacgacatcctgaacatcctcgacggcatcgacaccaagtcgtcgcggatcatcaccgtcctcaccaccaaccacctaaccgatatcaacccggccatgctgccgccccggccgcctggacgcgatcatcgacgtggttccgccggatgcggaagctgtcgttcgcctgatcaagctctacggcgctggcgacatcgacgagcaggctgatctgactccggcggccgagctactggccggtgcgattccggcggtcatcgccgaggtagtcaagcgttccaagctggctcagctccagctgcaagcgccgggcaccgcgatcgagaagatcaccggcgacgcgatcctgctggcggcgcaggccatccagagccaagttaagctgctggccgagcagtccatgccgcgtgtgactccgctcaccatggacagcctgctgcgcaacatcgtcaaggacgagttcgaagcgctcgcaatcgaactggacagcatccgccaactgtccgaaagcatccgcgaacgcgtaagctaaccgttcgtgccatcgaaagcggctccagaaggagccgtcttttttattcgaggttcacatgaccctatcgttcgattattccggtttgctgtacttcgctgccggtgtgctgttcggcatcctgatcgccccggcagctatgtcgctgctcaaaccccgcaacaagttcatggaaggtttcaagcacgcggccgtgatcatcgtgggtgccgatgatccggcggatgcaatcctgtacctgctgaacaaggtcgaagaatcgaagagcttcgatacgtacgaccagtacgacggcggtgtagaagcagccgtggaaatgttcatcgacggtatgaagaacagcgcacacatcgtgaattcgtacgaggtacaccgaagtgacacctattaatctctaccaccgccacacgcactcgtatgtgtctggctggaagtacctcgacaactacacctacatcggcaacgcactcgtcaagtcgcctatgcgcaagctattcgaagatgacgagagcgtgaagtaccgcggtgtgatcaatctgccgactgcgcagcgtaaacatatgcgccgggtgtggagacgaatcggtaaaccggtgagcttcggtcgtttcgtactcaacgcgctcgaagattactgggccggcagttgccagtgcgaacacgactgctgcgggtgtttctcctacgtggccatagccaagcgcgtgaaccacaagaagtacaccgtgatcgttcaaggccggcgcaacatatgaccatcgagatcatctaccacttcttcgactacctgccctggtacacagcgccggtgtggctgcttccgctcctggccttggcacgataaggaatcgacatgcctgaattcatcatcaccatgctgatctgcacctcgcctgatatctgcattccgttcaaagacgacagcatgcgctttacccaggaacggtgcgaagaagtacggcaagagatcacccgtcgttacccgcccgacaagttcgcattgcgcgtgaagtgcgaagttgtggagccggtgaccaagccggtacaaaccagccttgtcttctgaggtcaccatggaagagaacgaaaaacccgccgcgaaaatcgagcacgctaaacgtgctatccacttcacgctcaacgatcacaccatcaccaagggtatcgagatcgcgaaagacgctttggccatgcgcaccggtttggcatctggccagaacgagaaatacaagttcgacgtggataccacgctgaacgggtgggtgctcgtaaccgtcaccaaaactgaacccgacgaagcatggggtaagtggcgaacgctggcgctttcgccgacagctctggtcgagttggctatcgccaccggcttgatcaacgccgatctcaacaccgaagacccactgcacatcgttgcagttgcgggcgattaaccaactacaccgggggccggcatgatcatcgcgtctttcatggacttaacgctggacgttcacattcgcgtggaatgccggcgtgtaactgtgaccctggtcgagtacaagctcgtgtacgtgaggatcacgaccggcgaactcgtactctgccaacctttcttcgaacgccccgcggtcgagagtcacttccgtgagatcgtagaagacctgatccttaaacaacgaggcactgtgcaatgaaaaagaaactggagttcgatggggctgaatttcatgcggtcgctggctgctggtgtgttctccggcagcatcgggagaactccccaccgcacgaactatacccctgcggcggtcgacaagcagacgcctgagcaaatcgaggccgccaagcagcgcgcgcaagagcgccgtgaacggcggatgaaacgtccgcaagggttcggaggctgaccatgaacatcaagcatctggcgagcatcgcccgtaccgactacacgaccatttcggtcgagttccccgagacgcgcggcaagttctacacctacaagaccgagctgccgttcccgccgaccgtcagcatggtcgtggtttcgtcgccctcgaaaggctactgcttggcgcgggttgtggaagtccacgacgtgccgcagatcgacgtgaacgcatcgtacgattacaagtggatcgtggccaaggtagacgattcgcgctacatgaccctggtcgaagaagacaaggaattcaccaagcgcatgcgggcgcacgagcagaccaagatttacaacgaactgcgggcgcagttcccgcaggccatggagatcatgggcagcatcaccggccgtgtgtgcttagacaagcagcaagcggaagctctttcgggagatccgatcgagaattggtgatctatcgctgcaccataccccgatagcgcaaggctatcggggtacaccagatattgtgtcaagttcattgcatttgaccgatgggtaggggcaagcccatccttcacttcccccctacccattttctcgcctggattagcctatggacatcgctttcctgtccgcacccgtgcctctgacgaaaacgtacaagcagcttcgcggacgcatcgaaaaatcgaactacccgaacacctcgtccttcacctcccacaccgaaacaccgaaacgcctcgaagtatttttacgccgccatcgtcgagcacgccaagcaaggccactgcttgctcaaggggcagctcaatcgcaacctcgtcgaggaatcccgcgccggctcgaccgagagcaaccaagccaccgaatgggtctgcctggatatcgacggcctggaagtcgagtccccgcaggcgttcatggatgccatcggcctgggcagcgtcagctatatcgtgcagtacagctcaagctatggggtgcttgacgacctgctgcgttgccacatcttctgcctactggacaagccggtcgccgcaccgctgctcaagcagtggctgatcgacgtgaacttcaacaccgagctgctgtgcagccagatgtccctcacgccgagcggcaacggcctgcactggcccctggatatcaccacctgccagaacgacaagctgctgtacatcgcgccgccgaacctgatcggcgtgcctgatcccttgcagcctgacgagcgctatcagctcgtgaagaacaagggtacgcacttcaagctgccgaagcagatcggcaccgtcagtgcgaaccggtcgcggattgacgacaaggtgaacgagctgcgcctggaagctggtatgcccaagcgcaaggcgtcgaagtacaacagcatcggccccgtcgagttcgtagcgaacccggatcaatgcaccgtcaccgggatcaaggaagaccgcggtttcgtctacctgaacctgaacggcggcgacagctggggttattaccacccggtagacaagccggacttcatctacaacttcaagggtgagccgacctacaagaccaaggatctggtcccggactattggcacgaccagcagcgcaaggtcgaagaggccgaagagtctggcgaggttgtcacgcatctggcgttccgcgacttcaactcggcgaagtattacaacggttggtacgacccggacacacgggagctggtactcaagcaagcagccagcgagaagcaattggctgactacatggccagtcaaggccgtgcactgagtgatcgaatccctatctggtccatggagttcttgccgtctgaggattggacgctgaaccgtgagtatgatccgccggtgatcaacacgttcgtgcagagtccttacctccaggccaagcgcccagctaaagcaccgagtgtgccgacgctgatcgcgcgtatcatccaccacgcactgggcggtgacgaagaggtaacggaccggttctataactggctcgccgcagtgatgcagaagcgtgtcgctatcggcaccagctgggtactcagcggcacgcaaggcactggcaaggggctgatctgcaacaagatcctccgcccgatcctgggcgatacctatgtccagcagaagcgcatggacgagttggacgagaagttcaacgacttcatggaacagtgcatcttcctcttcgtcgatgaagtgcagctgtccgaaatgcgtaacggccgggcgctgatgcagcggatcaagaaccagatcaccgaagaacggatcagcatccgcggcatgcaccgcgccgggcagatgatggtgaaccacgtcaactgggtcttctgcacgaacatgcctgacccgatctacctgaccagtgacgaccgtcgcttcaacatcgcgccgttccagcccaacaagctgctgatcacctccgaagagatcgaagcgatcgaagacgagctgcaacagttctgcgactacctgatgatgcgtgaagtcgatttcgacctggcgcgcgcggttatcatgaccgagcagcgtgagcgcctgatcaacaccagcagcaccagtatcgaactggcttgcgacgctgtacgccgcggtgacctccagttcttcctcgacgaactgccgagcgatagccagtccttcgtgctgcctgacaccatgctcaagttgtcccagtacaagcgcgcgcttcgtgaagtcatcgagcacgcttctacgggcggcaaaggcatagggcgggatgtgctccacactctgctgcgctacgtgctaccggactgccccacgtccagccacaagttcacttcgctgatcaagcaccatggcctgtacgtacagtccatgcgcatcggtacgcgcaccacgcgcggcatcgaagtggactgggtggtcccggaaggtgccctcgaccagatcgatggcgtcgccgataaaccggtcaacgacgagatttctccgaagaccaaagccgaactgaaaaagcacctgaaaggtgtagccggaggcaaatcgaaatgagcaacacctataccacgtacgtcatgcagatgccgaccgatccgaaaatgcgtagcaaattcgtcggtaagctgaacgacctcgccgacaagttcggtgttgagttcgtagccatgtccttgcatgacgagattt

SEQ ID NO: 633 - DNA, 1618 bp, Pseudomonas bacteriophage F83/13
gtcacgatcttcaaaaaatttacgttaacaggctggagccttagtgccacgcgggtttgcggggttttggccggtaaaattttgtcacgattgtcacgatctcaaaaaatttcgtaacacgctggagccttagtgccacgcgggtttgagccacttttgtcacgaatgttacgaagttctgcgctattccgctacagatacagtgtatatgtggccctatatacttattaactatatctattatttatttttttattttctgtagtggaataaagaagaaaagatcgtaacatcgtaacagaaagctctgtacccctagtgctgcctgggctggagcgtgttacgaaatttttggcggtttcgaaaatttcgtaacatcgtgacggttgttgagagtcagtctcatcctgtttggaacgaaatcgttacagcgatagaaaaagctaattggtttcaagaaacaaccacttaggttagcgatcgatacagaaaggacagaggggatcgggaggtgggtcggcccctccgctcccctcacacacgtgcggaaatcagtcgattttcaccacgtccaacttggagttatccacaagctggatcaggccgatttcgccgacctgattcatgaactcgacgatcgcttcctgatgtaccgcagcgtgctgagcagcacgcagcaccagggagatcgggttgtcggtgaactcgacaccttcacccatagcgcccaggacagcgccgataccgccgccgtgtacccagcccggcacgctgaccatgccgcgtgcggcacggaagtcgtactcgttgccgtccttgttgacgatctcgacgttggtggtgaagtagagcgacaggaatatgccgcgcttggcgtagtcggccatgatgttgtggagttctttcatcacggcttcggcgtcgacttcgttggtgttgcttttgatgatgtccatagtgatgtccatagcgcccaggcgcggttggtgattgagggtagaacgcaggaaaggcgctcgactccgaagagccgagcgccagggtttacatgaattccagttcggacttgtgggtgacgatgaagtgctccagctgtttctccagggagtccgcatcggccttgctcacggtcacgtcgctgaacgcgaggtcacgcagcgcacgcaccgggctttcgaggaagcgagcagcacgctgcgtgtcgcgttgcagctggatgaccgcagcctcggtggccttggcgaaggtctggaactgctgctggaccggaagctcaaggaacagctcgtcctcgccgacgccgttgtgggaaacgtcgtcgagcagcgtgcgagccagcggcaccgcatccttggccgagtcggcgaaccggcgggcgtcgaggtcgcgcatcttcaggatgtcttcaggcgacatgccggagattttcgacagcgcagccagctccgcggactgcgacaacttgctgctgtcgcgcggcgtggtcgccaactcgaacgcttggtcgacggtcatggcgcgctcgtactcgctgtcacgatcttccaggcgtacagcgatcgcgtagtacatgcggaagttgcgcaggatgatctcttcagcggtgatcccctgcttg

SEQ ID NO: 634 - DNA, 331 bp, Pseudomonas bacteriophage F95/13
tcgccattacgtggggaaagcttggtgcccagttcgggttgtccaatcaggatgatgctgaccagcttggtgaagccggcctcaagctcccgcaggcgcttgagctgcttgagcgttgggatcggaaggctgtgtgcctcctcaatgatgaggacgtggcggaagcctgcggcatggctggtcttcagcgccttgtgtagctgggcgaaacgcgcttcgggcgaggatttggtctttttcaagcggcgctacggccgccatgatcgattcagcgatatgggtcgatttcagtgtcttgcccttggtgtcgttgtcctccatcgccagcaca

SEQ ID NO: 635 - DNA, 210 bp, Pseudomonas bacteriophage F95/13
cgacccgcaatgcgccacaatcgacgaccggattaaaacggccttcgctgcggtcgcagggcttgcgacagacggcgcaccgaatgcgacctatgccgccgtcttgctgcaagccggaagcgccgtcgcgaccaacggggcgccttgctggaagcgtggcacggtatcgaccttccgcccggcatgatgcttccgaagtgcgcggcggtc

SEQ ID NO: 636 - DNA, 195 bp, Pseudomonas bacteriophage F95/13
cgtcgcggaaaagcgcaaggtacgcaatcgcagccgaaagcgcgacgacgataaggccaatcgggttcgaagcaagcgccagcgtaaaggcttttaccgcagccgtcgcaccggccagcgcaccaaccgaacggggcaccgaaggcaacaagcaacgcaacgccaagccctgcgacgattacggcaaccgtcttc

SEQ ID NO: 637 - DNA, 18757 bp, Klebsiella bacteriophage F92/15
cgtcttccagcgacgggccatcgccatcttcttcttccagatggaaaggcagaatagcgtactgcatgtcagctggcgctaccggggtgaaggtaggctctgcgggagcttccgccatgaacactgcggttccgtcaaccaggcggtcgatagcttcgcaaacctctagctgctcttcgatcttggcctcacgttcgcgcatcagagacagcatctcagtgcgatactcctcaatacgacggtctagagactcgatgttgttggacaggttgtcctgaacaatcatcaggcggactacagcagaatttccattagtaggacgtgtgtacatagtatttcctcagttaattgttaaataaagtcaccggtagaaactaccagtttaatgcttttacggaagatttccttgtgatcgccttcggctcgatgcaccataatggtgccaaccagtttgttaatctcaatttctacatctatgataccgtagggcatagcatgctcatcggtaagcctagtccatagttctggctgaagcgtacagctataaaagaccatccattcgtgatctccgtcccatccggcccaatcaaccaccagtgcagattcaataccagttgcagtaatcttttccatttgctaactcctctcattaatttatgaatctattatagcaattataagagcgtttagcaaatgaatttttgaattatccgctccgaagagcggtaatccaggcttgcagctgttagttacacttggtttgaagtttgcgagtcaaagcgaaaggggatctattccttacggacgaaagagttccaagcgctgagagctttcagggactgaaggttgatagcctccccgtttctgcaactaacaaatcttaacttgaacgtttaacgtggggattgattagccccactacacgctaaccccggaagggattgaaccttcacaagatagaccatttatctcagcctcgttttcgggtatcttatgcagagtggatgttctgcttacgccctttaggaagccccgtataccgattccggcacggcatcaacgcgctagggcaatgaccgtctaagtccctagattcgccatttatactcctggacggcatggagtaggatggttgtgtgagatttctctcagccccatcccagattccctagacttttacatagcattgcgctaaaacctgtgaaggtaaggatggggtattcttacgaatctgggatcatccccatcagaaattacagcttctcggacgtttgatggccctgaccgaagtctcactgtaaattggtacttgctgctggtttcgaaccagctaccctcgccgtgtaaagacgatgctctcccgattgagctaagcaagtatttggtggtcaatagtggactcgaaccactgtagtctcacgtatgaagcgagtgcataaaccatctctgccaactgaccttatttggtactccgaactggactcgaaccagtgacctaacgattatcggtcgtttgctctaccaactgagctatcgaagcattattgttcttgctgacggacgcagatttcctcgtccgggtgtatttgagctattctagcatcttcctcagcttccttgtacgtgtcatgaaaagccggtgcccaaaatacgatctcttttgtgtgggtattaattagcataccttgatagcgaatcatagttacctcaacgtttaccgtttcgtggtgctcctggacgtttggcagcttccgccatacgtttcttgacttttgcaatattctctggcgtttgttctggcttgtgtaagcccgccacattacaccactgatctccgtcccaggaggtgatcaataatactccactacctaaaacacgttctgtgaaagtgattcgcatcatcttctcctagaattggatgctccggcaagattcgaacttgcgatctccagcttatgagactggcgaggacggcctctcctctacggtgcaattggcaggggcaacaagaatcgaacttgtgacctaaggcttcagagacctccgctctacctactgagctataccccaattatgcgcactctgctgagtacaacgttgtgtctagggccagaacataaatgcttgcatttatgggaggcggctagaagagggatgtgacccagagggctaacctcgtcactctcagcagagattttatggtacaccatcgaggaatcgaacctcaaccatagagttcgtagctctatattctatccattaaactaatggtgcagtaatctggagggatatcttggattcgaaccaagatagactcgatccacaatcgaggtcattatccagttatgataatatcccaaatttgagcaccatcgagggctgatcagacctccacagatagaatgcacatcgcacacattatccggttagaccgcgtattggtacgttgcactttgtgcagcatattatcccaacaggcgactcatcgaacgatgatgctcaaatttggtggccctaagaaactcttcccacttacaactagttgattacttctggattttcgcccagaaaattctctagaaaggggcaaccgttactcgtcgggccattatttggcggaaagcgaaggacttgaaccttcatgcccttgcggactcatcattagcagtgatgcgtggctaccgtttcaccagctttccagttgtttggcggagaataaaggaatcgaaccctcaccgtttccgatggcgactgatttcaagtcagcttgctcccatgagcactactctccagttaatataagatgatgcctcgactacaccgggctgtttaacgccccgccaggattcgaacctgttaaaacagtgtttccaccagccgtaggtttcactgaacatcaaatttggtagggatgggagggggtcgaacccacacggatatttcaccactagaacctaaatctagcgcggctgccaatttcgccacatccccatttattagttttctttgatcagacttttaatcttctcaaagttttggtcagaaatacagataccttccagggcaaaagaggctctagagctttctaataccatgtctaccacagcatcaaaattttcctctctaaagaagttttcgctttcatttgccttttccatacgtactcctaactttaattggtggagtcacagagattcgaactctgctgctatcctcggtgcaagcgaggtgtccactcctagcagaccctgaccccaataatttgttaaggcaattaatccggtgcgcgtaataccctgagcaattagccatgcaaggatacccgctcttcacaaatacgatacactctacgcttaccaggcgtttcggagagtcactccgctattcttgcaaagcccctcttggggtttctactctacaagcgtgttttttggtgccgactctgtatcagattaattccttaacaaactatataaatattatatcaatttgttaagcatttagcaactgagtttttcagtaaatttggtactcccgacggggttcgaacccgtgttcccactgtgaaagagtggtgtcctaaccagcttagacgacaggagcattttaaatttggcaagggaaggaggagttgaacctaccgatctcggagtcaaaggccgatgccgtaaccacttggctattccctttcaatataaatattatctcaaattctaaagcatttagcaattgaatttttcaagtattttggtagtgacccggcaacgcaggtcactatgcaaactactcgccgtggtctacacgaatgagcggacaaagtttgtccttcttatagattcgcatcttctggtagatgttaccgaagcgcagctcttcatcgcgagcattatactctttctgtgccctttcgaaagatttactcgcgttccattcctggatccgatcccctatcttagcgcaggcccagccgatcccagctatcgccagcagaatcgctactatcgtagatagccctgctagacttaaccctacaagcatgtaccagggggtaattcccagctcaaaggtgagacccaagaacgtagataagatacttcccatccccaaggagaatagtacagcaatagcagttacgccaatctgtaacaggaaataccacactgagtgccaaaataggctacacaaggtgactctgttgtcgttcagccgataggtgaaagacgcggaagagaaattaagccacttgtagaaaaaacctttacgtttaatattcagcatatttagcctattacttgagttgattgatcaaaaagatttgtagcgcaataatgaatgcagcgtaggagtcagagcctttaccgccttcgttttcattgacttcttttagtagggcttcaaaagtcgccttgtgacgctcataatgccctctgaccgtcgggccagcgtcctctagcatgcctagaagcatataatactgggtttgtaactgagcgtccattagccctcccatacgattttaatggagaggagacgatttaccggaatgaccagcatagtttcagaccgtttattaagaacttctagaatatccccatcacggtggagcagacgtttagggctgatatcagttactgtggactctagaacgataccactatcatccacgtaggatacgattgtcgtttttagtagacattttagtctcctgttatgaaattggtggctcccggaggattcgaacctgcctaccttccgcttatgaggcgggtgctcatacccaatgagcttgagaaccagagaagggctatttctagcccttagttagttagttatactgctgcttcgtcttccggggtgccttccaccggaggttcttcagtgggggtatccgctaccggagtgtcttcagttggagtatcttcagccggctcaggatcttttacgaaacctgcttcttcgtcggagatcacgtacagatcctgaatgtcttcggtattgatcatacgagctacgctaccgtctttatagaatacggatttagtgccctcgttgcgagccatgttcgcatcgataaccagctcagtgagaacccctttctttaaatattcaattttgtaagccattttatcctctactttctctttgatttaaagaactattatacaaaatttctgacaaaattgcaagaaaaattttgtagaatcaatcttaatctgcgccctgcgggctttctgccgctgcccactgaatattacgtgtgggcagcgattaaagtggtactccctacaggattcgaacctgtgacccacggtttagaagaccgttgctctatcctctgagctaaggaagcattaataaagtttaagtgttttgacaaccagatcatgaacctgttcagaataccggccaacgctcttatgcagcgactctttaaactctagagtgcgcctggcgattagctgtttctgttcaggtgtcagattaggtgctggacgttcatacggaggagtatgcacagatgccaccattattataccttgatagagtttttgagacgatcgcattcagtggcgaactggacgtttagggttttgattgcgtccgtacactgatctatttgtttgtctagagctttgataagccccagcttcaccatatcgtaacagggtttcatttcgaaagtgtaatctcgagtctggctgccacacaggtcaaacttaatatccccggcttgcagtgtgaagcgtttctgtgtaccgccactaatgatttgtttagccttagtcagctcactacgacgagagaccatagactcaatatcagagcgtatcttagttaacatacttaaatcgttcatatagacctcgtcaattagtatctttaagaactctcgtaaaagctcttaaagataccgccagtagcgaaggacgaatcccctcattaagcgtctcattggtacgcactactgtcagacatatcttccagttatagtcaaggtgactaatataccttgccagatcccggccaaacggatatccgttggctaatgcggtctaggcgagggcacactccaaacaggggcacttctagcctgtgtaagggtgctataaatagtggttatgctttcgctcggggtgactccggtcatgactccattgtcacatgcttacacagggtatacgagcttccgcggagctgtatactcagccgtgtcccacttaggtctcggagcgaccgtttgtacgaacggttatccgaatactctttcccacttagagtcaggcgagatcccacctcgccaaagttcatacgatcatcatgccgtatttaaggactagttttggcacttctggagagccatcctccacgcggtctgttaaaatcacacctccgaattttcgatgtgaagtttggctatctctagccttccagcgtatggtcgcttcgcacctgccactcttacgttcaaatcggtttaggtggtggcaaccctccgaagttccgagtttggttgaggccgtcaggtttcctcgtggtttagctgtttcgttcccgcgagtctcccaagtcttttcctgggaggggaggaggtactccagcagcgagtggttcgccaatagaaccatcagttatctagctctttccgaccgcaggacttgaacctgcatcttccggcagttacgccatgataatgcccattatactaggacggcagtgttgctacataagtgatttcgacaccccactatggcggcaataactagcaccagacgctatacacatgtctccaatttgcggcctaggcaggtcagtgtgggagctatacgagtttctcaggctcagctccccacctctccggcaggccacgcaccatgcttcattctggtcgaacaggttaaagtgagattccaccattttctataaatcaggagaagagtttacgagactccgggacagctcccgagttttacaagagatctctaacctacgcccgtccaatacgctccctggccggtatccggactggatgcacgaactttgtcaggtgatcactcttaactcaccgattctattcaacgaatcttaatgctcgacgagtcttacattaaaacaagttcagcgtaatcggcccgctgttctctctaatttatgaaactattatatctaactttttaagcattaggcaactgagtattttaatttataaaacacatggttgcctaattttacttgttcttttgaagtccttgtcctttgtccagtaaggtttagtatccttactgtgaaaatacaaggctcccttcgtcggatctactggaagatccatatagtaaactagtctagctatctctttagcttgtttccactcttcgtctttacgatcgagtttatgtttctttttaccaacccagctgaactgccctggttgatagactactttacaatatgtggacgggtaattttccatagttaacacgtatttttcgttacttgtgcaactgcggtcattcctttaactccttcccctctagcttcaaagtacactatttttagctatgcactctatctcatgcgcatcaatctttgcctgcgcatggaagctagtgaggatggagatcattagaatggctgctttcattatttctcctttactctttgattcaagaataatagtatatcaagaaatcagccatttagtcaaatcaaattttcaatttcgattcgatagttttaatacagtacgcttctaccagggcgtcaaacaccggatcatgtttcgacgggtagaccccctcaggaatcaggttgtaacgctcgattacgtcgtgtgcgtagatttcagcacaacgtaccaacgctttccagtcccctccgagagcctcgaaatagtcacgagggttccgggcgctagagatatcccagaacttccacggaacgatcgcaggatcagacggagaaaagacgttagcctgagctgccactgtttcgtaaatagacatatcgaactgcgggccattaccgtagtggcgcagagaacgagtatcaatgccctgctcgtcgataataccttcgattacctgtttcgcctctacgaacgggcagatcaaatccatgaacgtatgcttggataccggtgacttatgagtcgggttgcaaaccagaacagtagactcgccgtctttagcgttcagagcttcaataatggacagcgacggagcactaccagcacgagcctcattcatccagaatgcaatagttccggcggacaccttagcaccgagggccaactgctgggcaacgttaggaatgcctagaacgatataaggatctagcgatagatctttcatcagtacaaaagcgaaagacggtatagcgataaaggtgctcttgcaatctcccggagttcccagggattcgatatcacaaacagagatccagcggtcttgtaagttttgcatattgtttcctttgttattaaagttgcttctagatgtgttatcacatttagaagccacctccggtggtggcttagtcatatcttcggacacatcccagttttcttccatcgacggccagtcagccgcccaatcttcgagttcttcgtagcacgaatccatcagttcccgggagttgaccctagagtaatctagggccgacttatgtgtcgctgcacgattgaaatcgtttttagtctacaaaatttcgcattatgccttcttagctggtttgcgtttttgtattacggggcttatttgccttgcccgtaaatttaatacctacgccgtagcacagagcgcgaacattctcacggctgtattcgcaaccaaagatattcggtttgacgctaccgaaacggccctgggtcttgcgcagaacttctttggtgtccgctttatccggcgtactccaaccgacgatcttggagacgtagccagaggtagaacccttagttaccggcttcttacgacgcggggccggtttacctacagctgatgctgcttgagtatcagccggatgtttacgcagatgacgctccagacgtgctttgcgattcgcttcagttttaggaaaagttgcaactttggtttctactgtcttttttagaggtctgcttagccatgatttatttcctttgttttgattggtttcgttaatttatgaatctattatacgttaatttttagcgtttagcaactgtcgttttttcattttcatctacaagctcatcgaagatgatgaactcgtacctgttaccgcccgatgtgcttcgcttgctcttccgagctgatgtactggtacccgcctttgttgtacgctggtgctgtacagagtttctttcgctcaatttctttaagagcggctcgttctctttcagccatctcaggatccaggatttcccgtgcctgcggtcttggtggtagacgcgtagagggttccccgattttgacgcttccagaaacgcggcgcagagatcgagctggtactgtggtacgtttgggaacaaatccctcaaatctggtgccattataattcatctccacccctcagagctttccactccgcttcaaagatttgggcttccatacgtgcgattcgcagtttcattactactcgatccacaccatgctccatcagcagcacttcatacttcatttcactaactaagcggcgtaaattctccaacatcacatatcctccatttccagttcggtcatgcgaacatttagtaggttatctgcggcctcattaccttctacaccggagtgacccttaaccttaacgaaagttgggatctcattgtggtttagacgatacttcttgagttcgtcaataatccacttccactggtctaagttcagaggtgtctcaccgtctgccttcttccagcctttacgttcccaaccccaaacccaggactcacaaccattcttaacgtaggttgagtccaaatagattgtcattggtcggccaggatttttgttagaccatagcagagcctctagaactgcttgaagctccatctcgttgttagttgtgttgcgtttgggagcagacttggtgccgatttgctcttcgctggagttgtaaactaccatagcccaagcaccaacgttgtctaccccacgggtattaccgcggcaaccaccatcagtataaacatgaaacattatgcgtgcccccaggaaatggtaattgattcagtatcacgttggtcaaacggatgatttacttttacttcatagcccgcgtcctttaggtcttccataatctgagaccgtgcggcgataggcagaccattcaatgcgtaagaatctacttctgttttacctgaagaagctgatccatcaatatttgatataatagatctgcgagctgctgtaactgccatatcgttagaccttttggctttagctgccattgcttttgcatcagtaaaagacatatttatttcctctctcaaatttatgaatctattatattagaaattcacgtggtttgcaaatgaatttttaatataagtggcccgaaggccaccttagttatagtaatttagctggaggaaccagtaaattactgttatagtcccgcttggctggagggttttctttaggcggtttaggggcaaactgacgcattagtgcgtccatgcccttgtactttaccatccctaggataacatctatgtgtaaccccgaggattgaaccagaaacttcagctgagactcctccctttcggagaaggttattttagggcgtctgttaaataatcccataagtcctcacgcggtgaacggatatgcaatagggtcatgagacttataccccacgattttaaagtcgtccttagaaacccaggtaagtacgtcctctagggtttttatctccggattgatctctagacgaggagccgggaaaggtttgcggtcgaattgaccatgttccatgagaaccttgtactggttctcgtagatgtgcatatttactatacgctggtttgctctgattgcccggttccctgtgatctgggccataagcgcaaggaacgtgtagcattggaccatgttaaaggcttgtcccaataggaagtcattggatctctggaaggagtcgagatacagatttccattgagtagcgagaactggtgggtatgcatgcacggtcgtaagcatccttgatcaaattcgccagggttccagaaggtgagaatctctccgcggtcatcaatgcctcgtcgtaaattctcatagatcttatagagttggtcaaagtgggaaccatccggtcgaagccacgttctgccctgtactccatagactctacccatatcgtcggttccctttctgttagggttgaccagccacgcctcgttttcgttggcgttagcgttccacgtattgcagccgatagcacggaattgctctgcggaatcatatcctcgcagatatccgataagctccatgatggcctgaagagcatacgctttacgagttgtgataagtgggaatttctttccgagtacatcatattcaaagtttgaccctattacggttaaacaacgaacccccgttcgagggttctccagccagacaccttcttcgagaatgcgtttgccttcattaatatagtgaatcacagatagactccttccataacaaaacgatagcgctcattttccccagaagctacatgagttactacagcatccggaggagtggacgtaagtatcgggtgctccagatacataatgtggtctaggcttggtactgtaccagccttgggataaatagtggagcgatagatcgcatccagacagcccatagttgctagagtttctagcaaagctttcccgccgatgcagactacttcaacttcattacagaagtcccgaattttggaacccaaatgggtaataaaccgcacattacggggagggttttttatcagaaccggagccttagaacctactacgtacaccatggatttcttttccagtgcttttttcagtcggggaggtgccgttgtgtaggtattatggcctaggataacaacctgataggtatccaggattttgtagaactgttctagctcctcggggatggagccccagggaagttccccgtaggcatccagtgtagccggattaaaaatcccgaaggcggcgtcaactcgcattgcgtataaagctgtaatcattacaggaactctccaaattcatcagacagatcgtccgggttagcctgagaggttgcaccaacacgatagttggtaatctgtgcttcttgcggagctacttgctggttcttggtgttcagccaacctttcatccagccaataggatcttccataattaccgggagatcttccggccacggaatgttgattgccataaatgccaggcgtgcgttgtaatacaggtactctaccagcaaatcggcgttcagacccggaatatcttcgccttccgggaaaatataatgcgcccagttaatttctgtctccagaatactgcgcaggatcttcggggcattagcctgagctgctgctacaacatggggaggaaactctccactctggataatacgcagaacttccatcgccataacggtgtggagcgcttcgtctttcgcgataagctgtaagttcttagcgatacccgtcagaatatcgttctccgccagagcaaaggtacatgcaaacgatgcgtagaacataatggcttctagagcgtatacagcgtagtagaactccaggattttctgctgtaattgttcggtcagctcttggaattcgtgcggcgacaggcacatgacgtcatcttcctgggccagctcaattgcctctcgttctttaagccaaatctctgctagttcggccagctcatcgataacagaaactggcagtgctaaacgtgcgaatgcttcgtcgttagcctgtacagtcgcaatgaagtcgcccggattagggagaacgttgcgaataatgttggagtacgcacggctgtgaatattctcaaagtagctccactgaataagcataccttccagctcaggacgagataccagtttacaaaatagcatcttccggagcacgggtgataatggagtcggcttgggtttgccaagctaagttcagcagggtcttgtttttaatatgctgaggcagattaggccattgtttcttatcggcttccagggagatctcagtctcaacccagaactgcgagcgttgcagtaacgccagttcctctagacgaggatagcgaacgtttacatagtcggcgattcccaggtcttggcccaggaatagtttagactcagtgtgatcccattcgcggttaaatactgttgccattgtttaatttcctctctcatttaatatacgaatattataacaaaaaatccaacctacttgcaaataaaattttgctttcggttggatcgagcttaattacagagtacaaccgccactggaacaaccctgctctgctgcagagcctccggtatctacgtcaaagtttgcgtagtagaggttcttaatcccatatttagtggagttaaggagatctttgataatctcagtacccggaataatacctccaggatatttgttaaagtcgtagtacaggttggcgctaatagcctgatccgtgaacttctgcagaactgctaaccacttaatgtgctcagtacggtcaatatcgaacgcatacttataggactgcatggtgtcccaatcgtctagacccggagctacggtgattactttgttaacgcccgaagtcttgatagttactgcactgcgaggaggctctactgcattggtaacaccaatcagaacagagctagactctcccggcatacttgccgttaggacagagttgcgcataccatgagttttgatctcctcacggagagactcccagtccatttctagacctacggaaaccaggtcatccacagtcttcttataagtatcgatcaacagcgtaccatcagaagtgtgagtgcggtggaaccattcacatgggccgatctcttttgtccagacgtacagacgctttgtgaaggaagaacgatgccttctctgcttcacggtggatccagttacgggcttcttcgccttcgaatgccaggccttcagcggccatcgctcctgcagcgttcatcagtccaatacctacgttacgacggcgtaatgcagtgtacttcatagccgggaacggatagtgctgaatctcgatgatagtatcaacgaatttcaacaggatgtaagagatcttctcccattcttccagagttttgatacgacctagggcgaatccgcctaagttgcacagagatacttccccatactctgaaacatccattttatccagttcttcgtctgtacggtacagatctaccacgtgagggatagggaacgttggctgtacgatctcaacacaaaggttggacatacgcaccggatctttgtaacggctgttgcggttcacttcacccgcatccatagtgtacaggcgaccggtttccatacgtacggttttccagaactcaatcagttctgcggcaggaatcaccggggctacagggagaacttcacccttgaacccacgtttagtaacacccgctagacgtttttcggctgcgatgtatagacgttcaaattctgctacgtcgccagagtcaaatgctgcgtatacttctggagcgtacaggaagctcatcagtgtgatgttctctttacgcaggaagcgtttcaggagaatactgttgaacttcaggttgtagtccatcttatcgattttcttttcatcaggggaacggttgctcttagcctccattacctgaatgatttccggatcgaagaacgcagtgtaaacagttgcagaaccaccacgggactgctgggtgttagcttttacggagcggtcgatgtgtcgataatatggcagttttccagagtgtgggaacgcgccttttcgcaccggatcagcaattgatctactctcaagatgatagccgatccctgctcgggcagcgaccattttgaagacgacgtgctctgctgcgtcaatggagtccagggtgtcagtaccatcaacaagacagcaagaagcgaagcccctgtcagcactccgaaggcccacgagcggcggagttgggacgttgattttctgtagcgacagcgcgttataaaggtcgattgcatcgagcatactccagtgaggttgagaaagcattgccattgccatacccatgtaggcaaactgcggagtttcatagatctcttccgtatagatattacgtctagagtatttatccatgaactgcttcagaccggcattagtgaacagttcgtcacggctatggtcaataacttcgtttagagcttcaaactggtcgtcagaaatccagccgctcatatcttcccatgctcccagctctaccatgtggtcgtggaagaaacgcagagatggcggggtgtaagaatcaaacaggttcttacgtagctgtgctaaacgcagctctagggcgaatcggtcgtaacgatgatcacgctcgatcattgattcagcagacttaatcagcattgtttgcagatcgtctgagtgtacatcacctttcggtaggttcttaactgcggctaccgctaccggagaccacggcacatcgcttcggataccgatgtattttgcccagtcattcagcttctgagccatgaacggttcttttgtaccgtcacgcttgataacgtattcaatacgttgggtcattggtaactccttttggaggttgtcaggatttaagaaatattctactttgttttcggccattttgcaaatgagattttacagacaaaaacaaggcaacccctttcgaggctgcctgtgtgtcggtctactttaataaaagtgtaattttttctattcgactaactaactctttagtaccgaggggttggttaggaaactcgttcgctatcttgaaagcggcatggtgtcgccgctcatcttcaggatagttagcattgtatttattgactgttgctagggatactggatgcactttcgttttacgagtgcggaagttgttcagtgtaaatacgttgttcatacgcgctcctagagttagaggtcaggacgttcgtcgtgagaagtgataccttcaccgaagcctacaaagccccagttttcttcagaggtaataccctcaccataaccaatgatcagttcagtaaccatattagattcccatatcgttaaagattgcctggaatgctttggattcagcggaacgcacgttatcatgcaactctactaaggagaatggcacatgttcgtactgatcgtagatatccatgatcagttgcagaccagaatcggatttaatgtctttctgcgctacgtcgccacagattactaatttgcaatcctggcctacgcgggttagaatacacttcattgcttctacggagatattttgagcttcgtcaacaattacataagaattgttgaaggtacgaccgcgtgcatgttcgatagcaaggtattggattgccttgcgttcaaccagcccctgataagaacgttcccctaaggcccatttaaagccatcggcgattggttctaaccacggtgccatcttctcattcagatctcctggcagcatccctagggatttaccaagaggttcgttcggacggactaggatgaacttctcgtacacagaaccaggcgttgctaactcttgagcagcgagaacagatgggataaacgttttacccgtacctgcttctccgataccaactgttaccgtaaagttacggatggtgctgatatagtgtttttgctcagcgttcttcggcttgagttcttttgcggttggttagaaaacgttcccgtcgcttcaaaatacaacggggagtgacgttttcgttgacgttcacgttttgtcgctaccgttacggcgcgactccttacgacgtgctgcttttctcattgcgatctccttagaggtctacagagggtcaaatttcgaccatgtttatcaatttagaataccagtataccaagttttgccgtggattgcaactgaaattttctagaatgatacggaggacatatcctttcctttattcgcgcgatgcgcgggcgcacacgaataatataaaatgggggagataggcaaataaaattttccggcttttattgttttgatgatccagatcaagttactgttgattataataaaataaggttgacatagctgtgtctatttgatataatatatgcctaactggaggaatatatgaacgaattagacctgattgataatatctatagtatccttgataacgagggtgaagaagaccttatgtttaataatgccaataaggcaagcgagcagtttcctacacagagggacatgatagctggagaggtttctaaatatgtggtagcacaggagcttccggcatacctcttggcggcgcataataggggggagatacacattcacgatatggactaccgcgcacaggggtatactaactgctgcctggtggatttagcggggatgttcaagaacgggactaaaatcggtggggcagagattgaaactccaaagtctatctcgactgcagctgcagtaactgctcaggttatcgcccaggtaagctcatgtcagtatggtggtacgtctatcgaccgtattgatgaagtctttgctccgtatgtccgtaagtcttatgataagcacttagctattggccagcgttggctgcacgatagtaagaaggctgcggtatacgctactgaaatgacggagaaagaagtatatgatgcttgccaggggctagagtatgaagttaacactctattcaactccaacggtcagcagccctttgtgacatttgggttcggcctaggggaatcctgggaggcacgtatgttgcagaaagctatgctggaagttcgtatacgtgggcttggtgcctcaggtcatactgctgtatttcctaaacttattttcgcagttaaggaaggactcaataagtccccaagtgatcctaactacgatatcaaacagctggcgctcatctgcacttctaagaggatgtacccggattacgtgagctatgaaagagtaacggctgttacaggtgattttaagttccctatgggttgtcgatccttcctttcagctattgaatcgggggaaactgcggggcgcaataacctaggagttgtatctattaacctgccgttagttgccgtagagtctgaggggtgcttcgataagttctggaagctgctagacgaatacattgataaagcgatggctgcccacgattgggctattgagcggttgaagcgtgtgcgtgctaaacaggcgccaattctctatatgcacggagcctttggggtaagattgaaagccaatgatcttgtatggcctatctttgagggcagggcatcagtgtccttggggtatatcggtattaacgagctgatcgaggtaatgtttgaggataccgaccctatgtctccacctgcggttgaattttcagtacaggttctcaaccacatgaaagaccgttgcaacagaaaagctgaggaaactaatcttgggttcagcctttatgctacccctagtgagtctctgtgcaataggttcaacactaaaattgctgaacagtatccggagtatgattggctaacggataagggttatctgactaatagtcaccacctgg

SEQ ID NO: 638 - DNA, 14319 bp, Klebsiella bacteriophage F92/15
atggagcgttttgacgttcgtctagaatgggattggactcgtggtactggtgctaacgttcgtgaattcatcatccagtatataagtaacgatgagtttgcaaaaactggatggactaaggccaacaagctaaacgtgggtgcagctaaagctggtactatcactagcttcccttataagatccgccaccgcttccgtgtactatcggttgcttggggtccggatactcagtctataactaactctaacgaggttacttatattatagacgagagcactactttcgacaacgcattcattaacgagaccggtgtagagatgacctacgcaggtatcaagggtaaactttggaactctaacactaatcagtgggagcagactttcttagtcgatgctgccacaggtgcagtagttcttggtatactcgatgaaaatggtaaagcgccgatttcattcgaccctgttaataagattgtaaacgtcgatggtaaagttattactaaagacattaatgctgctaacgtaattcttactaacctgaccggtaaagacaacccggcaatcttcactcagggtaagaagtacggtaataacgcaggcggtgtctggatgggtgttgacaacactgatggtaaggctaagtttgaccttggtaataacactcagtatgtacgctgggatggcgacactcttcgtatttctggtaacgttgtgatcggtactcctggaggtgatgtagaccttgaaacaggtatgcagggtaagcagactgtatttgcttacaaacttgggacatctctgccaagtcgcccgcttgaccaagtttatccaccagctggatggtccgcattcccacctaaccgtactgaacagaaccagaacgtttacgttgttcagggtacccttgatcctaaaaagagccctcctgctctggtagatggtaccaactactcagccgcgtctcagtggtctggtgttccaggtactggtggtactgatggctccaacggggattacactgttcagatttaccagatcaatgctagtaagcccacgaagccaggtaatatcaatgatcctagtggttggagtcgtaccccaccaactggaacccctctttggatgtgttctggtagattcgatggtaatactaacgcactgaaggtagaaggctggtcagaaccactacgtgtagacggcgagaaaggtgccaccggtgctactggtccacaaggtccacaaggtccggcaggtggttcagtagaagtacaatggtctaaagatggtactactaactggcatgcaaactttactactggtgatatcttcatgcgacagcgtgttggtaccggtgggtggagttcagcgatccgtgcagtcggggaagatggtactaatggtactccggggtctaaaggtaactacattgggatgcgtttccgtgtggcagctgaaaaacctgatactcctacgggacaagctccttcaggttggtcagatgcaccccctcagggaaacccgctatggatggttaaggccgagtttaatggacagactaacgctctagtcggtacatggtcagagccagttcgtattgatggtgaaggcattggggtaaacctgtatccggttaagaaaacactggagcagtggaccggaatgagtaatggtaccatggttaagaatcctgataccctcagctttactataaccaacacagaaagtaccacctcttctacgggaccgggtgcacaccctgttcccttccaaggttcgcaggggcctatagttgagattcctgtaaagccgaacacgtcgtacatcttcacttatgaggttagtactgatagtaccagctttgctttgagagacctgttactagagttctctagcattactggaagttttactaatttccaagagttactgaccggagctaaaggtaagcaggaagctaagattatcactcgtgctgatactaagttcctgagcttccgtccaggtgttcgtactgccggagcaacggttacctactccaacctaaaacttgaagaaggcattaaagctactgcttacagcgtagaagcttccgacagtatcggtagaaaaaggggatcaaggtactcagggtccacaagggcctcagggtaatcagggtccacagggtaaccaagggccgcaaggtgctaagggtgataatgcaaaaggattcagcctctcttctctcagtcagacgtttacgtacgacgcagaaggtaaactgaagtccgatgcaaccatcctgttccaggctttccgtcagaatactacggctaacgtagcgtggtctgctaaagacgagaaaggcggtagtattacactaacaagtactagtaatactggtgctacactgactgccgctaacttcaaaacatcgaagtctgtagtagttacagctgtttgtgacggtattaccgatcagatcactattgtgcgcctagacgatggttccaacgctcttgtaggtcttctgaccaacgaaggttccacagttctagcgaactatgctggttacgtgcagaactacagtactggttctggtgacttcaaagtattctatggggcgaaggatatcacctcagaatgcaccttcagtactatggagaagaataaccttgatgctgatattacttcagcgggcaaatatactttaaaaggtatgccagctggtactgatgttatcaacggttgggtcgacttacgtgctgtacaccctacttacggtgccgtggttcgcagagtggcaactactaaatctatccttgcaaaaggttatgatcgcgttattaccacttcattcgagaacggaaataagggtacctggtcgactggtagtgttcaaggggtttctggtgccacaattgtagccgcaggtttcagcaaggccctagtgatctctgctagagactgtatagaagatgctaacgcattccccgtagtagctggtcagaaatataggctgggcatgtggataatggctaacgagtctaaagtcaatatcaacatgggaatgcgaatcgtaagagcggctgacggagctgttgactggcaaggaactcttatgattgcacagggtacaccggtacctggtggctggtcttacatcgaaaaagagtttactgttggcagttctaataccggtatagcaatgccttggatccagatgaatggatcttctggtagtgacctaggtaaagcctatattaccgatatccacatttttgccctagaaatggatggggagaaaggtgatactggtgcaactggtgctacgggttctcaaggtccacaaggtccacaaggtaacaaaggggacaaaggtgatactggtgcaactggtgctcaaggccctgctggtaactctgtaaacgtccagtggtctaaggatggatctactaactggcatgctggtttccaaactggcgacattttcatgcgtcagcaggttaatggggtttggggcggcgccattcgtgcagttggggaagacggtgctgatggtactgatggtgactacatttcaatgaagtttatcgttcaggatactaagccaggaacacctaccggtaacaacccaggtagctggagtgatgctcctccagttggtagccctttatggatgactaagggcacaatgaacgctagcggtcagctgcaaggtacgtggtctaacccagtccgtctggacgggactatcaaccctaacctgttcgcagttcgtaagtggatggcagcgatgactggtacggaatccggtacatctaagaacgatatcgagaagctaacgcataccttgactcgtacttccggaaccgataactcggctccagggtgctatgcaactccgtatgttggtggtggagcgttctctcacccagtgactcctggtaaacgctacacactaacctataacatcgatgcagctagcgaagtccagaccagagatattatattctggcaggctaatccagattcgtctcagtccacttacatagaagaactgaataccgggacatctataaaagttaagcgcacttttgtggttcctacaggtatgaattacctaaccctacgcccttccgcccttacccttaacgtagcgactacgtggagcaagatcaagctggaagaaggcggagagaaaaccgagtatcaagtagagtactcagacagtattggtatagtaggtaaatcagttctagtacagtggtctaaggatagctccgcgagcaactggcatgataccttccaaacaggtgacttgttcatgcgtcagaacgttgacggtgtttggggtcccgcaattcgtgctatcggtgagaaaggtgagattgggcctgacggtaagaaaggtaactacaccaatatcatcttccgtatttcggatactaaacctgctaaacctacaggtaaccaacctacggattggtcggatgctccacctgatggttctcctctttggatggcaacagcaacgtttaacggagatactaacgctattattggtgcttggtctgaccctgtacgaatcgatgcttccggggtaggtgagaacttctggtcacttaaagagtggatggcctctatccagagtgcgaaaggaaacggttcctcgattagtaaaaactacgatcagctaagattcagagtgactgctggggctgccgaaactgatgcgtatactcaaccgtactttggccctggaacgtacttcatacctgttcagaagagcactatgtatacggtttcttgggaagtggatgaagccacgaaagctcggttgtttgtacttcagttcgacaatggagatggtaactcctttgttagaaataattacctggagactaacaaggcagggagacactccctaactattaccacaggggctaatacagactatatttcgctgagattctctgtaaacgcggcaggcggaaccaacgtcataagtcgagctaaagtggagctaggtgctttccctactgcgtggattctcaatgagtttgacgctagaggtaaggatggtgcagatggtgctacaggaccacaaggtccgcagggtaacactggtgctactggtgctacaggcccacaaggtagtaaaggggacacaggtgctactggtccacaaggtccacaaggtccgaaaggtaacgcaggggagaatgctaaagggttcgccctaacgtcagattaccagtcattcgtgtacgatactggtgggggatattaaatctgccactactattctgttcaagggactaaaacagaataccactgcagggatcacgtggagtgctgtaaacaatactggagctgcagtaacactcatgaactccggagataaccgtcagctaaccgctgctaacttcggcacttctaaatgggttacggtaacagcaacctgtgatggtttatctgaccagattacagtggttcgcttgcaggatggcgagaacgtgttgaccgctgttatgacgaatgaggcagctacggtacttgctaactattccggatattgccagagctacgaaaacgccaaaggtcagatgagagtttggtacggaagcaccgatgttactggtcagtgcactttctctgagggcggaagaagtaacgtaactcctagcatcaactctacgaatggaaactactccgttactggtatgtcagatggaactgatgttactgaaggttgggtggacgttaaggctactcatccaagatatggagcaattaccaagcggtttgcggtaactaaggtgttcttggccaagagctacgagatggttatcaccaataccttcgagaatggtaacaaaggttcatgggcaggaactctacagggtgtttccggtccagcaaaccagagcatctctaaggcgttgcgtatcacagctagggataacctagaaggtaaaaacgtacatccccgtagtaggcggaacaaaaagtccgtatcagattctggtacaatccgctaggtttagaagaggcgtactttagagtaggctttattgttaaccgtaaggatgggaacaagggttacccctccagaactgtggttactggccctgctccgagtagttcttggacgtactttgatcaagagttgactctaggtgctagtgacgagggtaccgcttggccgtggttccagctagataacaaaacttctggtgcttcattgggttatatgcttattgcggatatccactttgaagacctgtctatgacggggcagatggtgctacaggaccacaaggtccgcagggtaacactggtgctactggtccgcagggtaacaaaggggagtactggtccacaaggtccgcaaggtcctgctggtgcttcagtaggggttcagtggtctaaaactggcaacgctagcgactggcatacaaactatgctgctggtgacatctatatgcgccagcaagttaacggtgtgtggtcttcggcaatccgcgcagttggtgaggatgggcaggttggtgctgatggtaagtatacctccctgaggttccaagtagctgcaactaaacctgctaaacccactggtaactctccggctaactggtctgatgcgcctccggatggctctccactatggatggttaagggtgaattcaactcgagcaaccagctccagggaacctggtctgacccggttcgtctagacggtgagacggttaacctcaacctatttgcaaacaaagcatggattgcgtctataacaggtgccagtggtagtggatctaccgtcgcaaaaaaccctgacgaactacgcttacgcattactgcaggttctggtgctaacgatgcgtataccatgcctagtggtggtgatggaacgttcttcactaaggttactgctggtaagcgctacactatgtcgtttgacactgatagtgctctggaaatgagaatgcacgtgttctttatccaggcaggtgcgaatactactacctcctcattctcttggatagcgtcaacaactgctggcagaactagctggtcgttcactgtccctgcaggatgtgatagggtatctgtccgtgtgtcactgaacaacaacccaagtgggaccaacgttgtttccaatatcaagctggaagagggagatttcgctacagcgttcattaggaatgaacttgatactattggtgctgatggttcacaagggccacaaggtccgcagggtagtaaaggggacaaaggggatacaggggctacaggaccacaaggtccgcaaggtccaaatggtgctagcgccaaagcttttgccttaacatccgatagcctgtcatttagcttcgatactagtggtaacctgaaatctaatggtactattaagatcgatagttggagacagaataccactgctgcaataacctggactgccaagaaccaagcagggagtactataactttaggtggcactgctactaacaagactataacctctgctcagttcggaagctcagagtacgtaacagtaaccgcgacgtgtgatggaataaccgattccattacaatagttaggctgcaagatggggtgaactctctagtcgggtacttaactaacgaagcagctaacctgtcgtgtaactcctacggttttgtgcagaattgggatggcaccacgggtaacttcaaggtgttctacggaacggtagatgttaccagtcagtgtaccttcggagtggaagataagagcaatcttaatggcaacatagggtcaagcggttattatgcccctagcgctatgccaaacgggttggaaattacctctgggtgggtagattataaggctacacatcctaagtatggaacacttattaagaggtttacactcaagaagagtctgcccgggattggttacgacagggtgttcacgggatcctttgactctggtaacaatggatcgtggggtcgtacggtggttgacatcgctacaggtagtcccgggggacacactaaggctatacagtgcacctctagggacaccatggaaagcagtaactggttccctactcgcaaggggatgcgctaccgtgtaactgcatgggtgaacaactccgagggtgagtatcagttgagattaggcctccatacccagaactctgctggtagcgttaacactggttacccaactatgctagccgcatcagctaaggattccgagggatggaaactagtaacaggtattgtcacggtaggggacgggtctactgcggagaccggtagagcaagaccgtttatccagatgaatggtagtgctagtcctttcggcaacgcttacgtggctgctatagcgatcgaagatctgtctatggacggtgaggatggtgctacaggtccacaaggtccacaagggaatactggtgctactggtcctactggtccacagggtagtaaaggagatacaggcccacaaggcccacaagggaacaaaggggataaaggggacaccggccctcaaggaccggcaggaagcagtggtgctaaaggagagcgtggtcctgggttctatactcaggctattacaaacttaaccgggtggaacgatactcaggcagcatctttcttccagtcaacattcggtggacctcctgttaagtatgacgtactaacccagtataagtctggctctccgcagaactcctggactcgtcaatggaatggcacagcatggactgctcccgcattaactgttcacggtgatatgatcgtttccggttctattactgctgataagattattgcaagcaacgcgttcctggcacagattggtgttgacatcctttacaatagggctgccgcactgagttctaacccggaaggtacgtacaccatgaaaatagacctggctaacgggtacattcatataaggtaacaaatgagcacggaaaacagagtagttgatattatccttgatcaaaacgtgtcgtatggattgatgctacagttcatggatatcgatgactctgcgtacccagcaacggaaacccctgtcaatctgacaggggtaacccttaagtcttcaattaaagactcactggaatccactggggtaaaattagcagatttcgtcgtaacagtaataaacgccacacaaggtcaggcgtcgctaggattgacagcggctactgtggcaacaatcgttagcaaagcaagtaaagaacgagataaatataatcctagacttcggttcgcaggttactacgatgtaatcatgaccagaggaacaggagctaccgctacctcttatagagtaatggaagggagcgtgtacgtcagtgacggagtaaccgcgtaatggctattacaacaagaattattgcacaacaggttaccgcccttgacggagctaactcaagggtaagtaaatacccaaaatttaccgtacagctaggctactcagttagttctctggctgctacagaattactggatgctgccactaaatcggcagcatccgctgctgctgctaaaacttcggaaactaacgctaaggcttctgaaaccgctagtaaaaactcccagacagcagctaagacttcagaaactaacgcggcagcatccgcccaattagctcagaatttggcaggtaaaacgtccctagtaacaccactaggagtgatgacaggctcggcagaagctaagattgcatctataacaatagctgcaaatcagtcttccagcgttcacgtattgtttgctctctacgctacaggtaacggagccaacagggatgacatatataacatggagatagtatccctggcgctacccggtcctgtaacctctgtaaccgctgataacatcggtagcttccttagtcatcgagtaataggtccggccaacacgaatggatttatggtggggcttaagtccactatagagggtagcaatgtaacttacgatgtatacctcaaatctcgtagtagtttcagagaccctaagatggcattcttatctggctctatatctgttactccgcctaccggacctttggtggatggaacagcccctgcgtggaaaaccacaggttttgatactgaggttatctatgtaaatagggcacaagtgatcgatgatggcattagcctggctaagctcaaggctttgagagtaactggtgattctggaagtgagtatctcacacttaccgcaagacctactggtggaataatttcgctgaataacagatctatttacctacgtcctgcaggtactgaggatactgtggcttctgtagaaattgccccgaatggtaacttagtcttccctctcacagcaactaagaaccatattctttcatggcagggtggcgccaggatacgagctaacgataccggcacaatggttatttcagggaacaatggtagcggacagactacggggttcctagcttttaggcccaacggggatagtgctactactacagaaatacaaatgcgatctgacggtaacctaaagcaaaccgccgcaaacgttgatgagcccaatgttctgactcgtagggacacagttataaacttgatcagctctagagcacctgaggctggtgttacttccgaggccttggcagatttagacgtcaataacaccgagagcggaaatgatcagtgggggaaggggtgttcagttacaacaggctggagccggaaaccaaaaataactcccggtaataccaccggacgcttaggtactatagctacgtttcgtcagtctcaataccgtttatctcaaatatcttcgattccaacactgggaacggcggtacgtcacttggggtatttgttcgctcactgagagcagactcaggaactagtccaagaccttggtttgccctataccatgaaggtaataagcctaacattcagtctggtatagcaggtattactatagacggtaacggttttgtcaagaaagcctccccgatcgccaagctcatcgcagaaattcctagcaaagaggattcgttcttctggacaggtgtggaaactgtaggaggctacgtagggtgtaacgcagaggctcaaggtgtatttgctagtaaaaactggactaggcaggtatacgattaaggggagtttaggctggaacacggaaggctggaagttcgaattaccaagagatgacaatggtaatatgttatgcttcgtggaatcggattggaacgaagaggagaaggagctaaacatacaggtattcactcgtaaatttgatattaacacaggtaatattattgctggtgagcctatggaaataccacaaggtcgttggattgacctgcgtctggaaatgccaaaagtggaaatcccggaagtggaatttccagaagatccagaggtagaataaaaacaaaaccccagtcggagcaatccgcttggggtttttctatttacatcttaccagaacttccgaagccaccttcgccacgatcagtatctgtcagactgtcgacaatttcaatgtcgttgggattataatgaggtacgatcaccaactgacacaggcgctcgaagttatcaattggctgagtctcattgctcatattcaacagattcatcttgatggttcctcgataatccgagtcaatcacccctgttgtattagcaatcattaaacgacgttttcctagagaacttctcggaaccacgattcctacccagccctcgggaatctcaaccgcaactccggtatcaatcatcaatgattcccctggaggtatggcacgcaataggtcggaagcacgatctccgaagtaggcccgtagatccataccggctgcttccgaacttccaacgtggggtttacaatcggggtgagataatttaatacgcattatacttctcctgtggcaatagccgtaatgtctttaacaaattgatcgtagatatcctgtcctgctgcggcaactgcttcaccacagaaacttgggagatctactagagttaggttacgttccatgagttcgcctgatttattcagcgcttgaacgaatttttgagtccccgggagtggcaacgcatcaataatgtctagaacactaccgtgttcccggattagattatatccacgtttttcaccgataccttccacaccccggatattatcacccatatcgcccataatggcttttaatgagatgaactggtccacagtgtctacgttatggttgtcgaacatatctttctcgtgatattctttacgagtagtaaacgagaagcgtgagatattcggagctaacagagtgtcccagtcaccgtctgtagagattagccagatatggtcgtagtggtggcctatcagttgaataatgaaagccgccatatcatctgcttccaccccgcggattcggaaagtagggaattgacttgcgatgagatcaaacgcatcgtctaagtattcgaaaaactgacgatccgcctctacttctgcttcggagcgatcggcgtacttcgcgtctcggttgcccttatactccgggaaaatattagtacggaagatactcttccccttatctcctagaacgatagtgtgcttcgcatcgtaggagtttgccaaagagttgatggtgtttgcaaaggatgctgcaataggcttgccactatctttcttgaagcggaagcccaagttcgtaccatcaacaatcataagattacggcgtgaggcgaggcgttgttctgcctcacgtttcattgttccccaggatttactcatttaactaaatctccaatatcacatgcgtttaaccacggctacaaaaagaccgataacaatttccattccacgtttatttactatgaaatgtgctctactcatgaggttatcaatcatagggtcgctactatccagagcgataagccattgaccacgatctttcttaaagatcagggcgggtttcatgttcatttgctcaccttcacgtgcggcttgggcccaccatttttctagctgggattctccaacgtttaggatattgctattaaatttctcgtctgcgtagtgtttgatctcaaagcagtattggctcattttacctacactaggtggtaaatatacatcaccctttagggagtgagactgtccaaaagcccctgaaccaggaacacgttcccagtccaaggaggtatacttacgcagcatatcacggatttggtactccgctcgttttcctttctcgcgactatctacggccattaggcctccaaaattgataagccagcttcgtcttgtttaacctcaatcttatgtgcatacggatgcgtatgcccgtgagatactatgattgagttcagctgatcttcttcctgtagaagttctacgagggtattaattccgtctgggtcaatataacttacaacttcatcaaggaagagcagattgatattaaccttactaattgttgaaagcaacattcgaattgctaatagcgtggagatattgatgcggctctgctgaccagttgagcagttaaccatagaagtcctgttaccatcattgtagatgacaacctgtagcttcgtctcgtccaactcaaaccctagagcaaatttaccgctggtcatgatagagagatagtggttgatcatctcctcaaataccttgacgctgtgctctagcttataccctaccagatctttcagcccggtgattaagatatccagatccgctacttcttctgcaactaaggacagttcagcctggattttatcaaactcctgctcggccttttgaatctgctcacgtttagcttcatacttcgcgttttcacgtacaactgattcgttatgggttcttgcaagctctacagaagatctgccttgacgaatgctagactcaatagctttgatacgttcagctagtccactagcgtctacgatttcatcctgcgttccattgacctcatcaaattccttgaggtttttgtcgagcctgttccagagcgttaaacttagagatataatccttaaacgccctatcttccttcctaagttcttcaacttctgcttccagcttttgacgttctttataaagcggatcatactcctccttagttcgtctcatagcctcttgagcagcagaggtatctaagtgagttccacacgcagaacactgggttttacctgctgcatttttgtaaatcgtagtaacgtttcttcagatcgtccgctctagttgccacgaccgttaggtcacgtgtaacactcaggagttcctcagatttcgaggtgggcgcaggtaaattttcgtaatggtgcaaaa

SEQ ID NO: 639 - DNA, 11044 bp, Klebsiella bacteriophage F92/15
aactcattaactttgtcttttgccaccttggtagcaagtttaggtttagcggcaaccacgccctctttggctctagctgcatccagtttattaatacgtccatctaaatcttcctggttcttagctaggttggttatataggtagtggtgttgcgatctcgatttcgaatctctgtttggagattaccaactgtcttttctagttgttcattacggtttgatagggactgtaaagaactggacatatctgttagcttattggtaatgtagtaggcaccaccgaaggtgcctgctgcaattgccagaaacagaattgctccagtcttaccgctccatattcctgaaagaaactttagcatcgaagcccttagcaattaaccgatcacgatcagacgtagattcggtctttggttccccttgacccagcacaccgaagatatatgattctaaggtctggtgccagcgatacaggtttggatcaatttcctgccacgggaaatcttccgcatggaagttgaaatcagttttaacggtaatattaaccgttgggtctgtcttagactttgcagcatcccatgccatcgcaatgggcttgttgaaggtctctaggaacgcagaagccgtagcagttgcgttacgcacataagcgtcaatcttttcgattgtattagtttcccaacccaaacggacggataagccctcttcttccatcagttcgataactttggcaagttcaaaggtttgacagtggtagccaatccaggtgttgcccccgttagggcggtacgtatggtacccatatagccaatgcaaagtaccgcaaatcaataccggacgaatctctagggttcccacctggtagaccccaaacttaccgttcttcacagtctcaaacagattagcatagaaaatgatctgttcgaaatctgccggcacgttcacaacctgcttaatctcttccctatgccaaacgcgttctgcgtcgtacatggtgccctgcaggtcatatacatctttaactttagagataatacgcatctttgttctcctctcatttataaaaccattatacaacattttaagcgagagtgcaagtaatttttaaaaaagaaaagcccaacacctttcgatgctgggcttggataattagcgatttagcgggttgtttttcgacacagtagttattaaagatctgtgccctcttgagactgtccggtttaggcttagcaaacgggcctttcaaagcgccttgtacacgaaaatccctttgcaaattctgccgatggtcttacgatccatgcaacggatctccactgcatatttaccactacgaagctccaggagcttatcgaaggatttcaagacaccttccgcgtctttggcaccccctctggcgattatggcctcgatatctttacgggtggcaaacttagccaggaactcgaaggctttagctgacagcagcttagcagagtccagaccatgattgataccaactgccatccacgctgatactgccagtataaataaagtaaacattttgcttcctcagtttgtctttgaattagttaatggtcagcgaccaactcaccacttcgttcatcgcgggcacgactccggataggaacaggaaggtgactcctataacggccctaccgttatacatgtggattcatgttacacatcatccgagtcttttctacttcccgtcgtgctttgcgacgttgccgccgtagcttgtattcattttctaataaccttatggaaatgatcattgatgttatcttccggcaacatcaaacgaattgttgccaactgctcgatctgaacccgaaggtgggagttaggcatacaaagctcttgcatctccacgaacccggataatcctagagcagtcatagaggctttagcgtatactttgtcctcttttagacttagctcaacggttatccggtaacgagaatcaaacacagtacaccactccgagggtactgccccggctcttgcccagactgaataaggagcttcctcaaaagcgcactcttcattaatccagtctagggtctcttgaagtttggggtgaagattactcatcgctatcatcctcgtcttctacctgacgaccatagcggtccagtgtcacagcgggcttgccgtaggttttgttcgtgtagatcttagtttctccaaaccgggtttcagatttgcggaacttaccagcttctttagtaatcccattcgttgttacacgaacccgcccgttatcagaaatctctactttgttacgctctgcggctagagacaccccggagtacatcataccgaatacgatgattgctgcaattgaacgcttactcataatcttcaccttcgttatcttgttcgtcaacttcaccttcgaggtctggctcacagtcccggcagatttcttctatctggttctccgccctttcaaaagcaggacaccaccacccacaattcacgcaccgaaagatctccatatcttccgcggtctgccagaagagatcctcgataacaccttcgtgaaggttatacccgttagccaccagctcttcttcgataacattgagagcttcagtttcgcttacacaggaaccttgtacatacccgtgcattaacgggcggataatgctttcaatacttagtttgctcatgaagctctccctatcaatttatgtaactattatatcgaaaaatcgcctacagtgcaactgaatttttcaatactttggcttcggcacgctttcttttgtattcagcagctcctttttcgagttccgaattaaggtagtcaaccatggtatcccacttacggtttatccagtgacgagtaccataatgcgagaatacttgtacggtatagtctaccggactggcatctttgacgctataccaggcctcaggactaaactgcttgagatcgtccagctgtggagttggcatatccagagctttttgatggtacagttttgtcaggtcaaatactttctgctggtaacgttcatggtcgcgatagtaaccagagagccgctccaccagagattgggctgcttccagattacgagaggttacaacgcaaatacgatccggcaacccttgctccatgaattcatgtactacacaatatccgagatccatattaacagctccagctacacttaggacacgggcaggacagtgcgtgtacgcacatcttgccgttcttatctacaccagtaccatgacatttggtacatgctgcatgtaaacacactggtcgttgctcttcaactaacttcttaataaacggagcgctttcaaccattttgcacaattcttcgtgagagtatccaagacctgtactaatcattttctacctctgcgtttcggagtgggccaggaattagtcttgccgtgagtaacttcctggcgggagctacggggcataaagttattgccaatcggatgttcgtgttccatttcccgagcgtaggattctaattctagaaagctggcttgggactctcgttccatcctttctagatcagtgaagctaggaaatccgccgatgccgccgtagccaataagcattattttcggcacctcgacattgcgttcttccagtcgtttacgaacaagttctattgcttcccgagcaattttatcgtccattgcgttcctccttcggtaagtaatcatgcagctctacataagagatgttctttctttctttgtactctggtttaccgtacataccgtgtacttctactactttggcgcgacgaggattattaaacataacgttccccggtatgactactacatcacctatctctggggagtacttccagtagctaggaactcggtaaacataagttctgttactgttggaaaacttaattccaacgtggcgaatagttgaagccatgatataaagccttagccgcctgccgcgacatgttaagtttttcggccagctcagaccagaagtctttaccgcttaccatgttatatgctacgatgttcccatcgaaatctttgagacgctcggcctctgcctctagagccggtcggttcttttcaacttcgagctggaactcattcagacgcatgaagttacttttgtcgcctagaaaacggacgtaggctccggcaacaccatctaccgaagatgcaccgcatttacaggtctgcattttgtggtcgaccaattccagggtgtcacggcagcattttacgaaatatacaactttactcataatcattatatccttcaactgtaaaccagcgtttaacttgtgtgaagctcacccaaataccctcatttgcgtcgctccgtactttgtaccctgctctactatcgtgtagttcaacgaagtagagcttacccggagtgaagtattgaaacttgtgacccccaacaattttatactggaggccaactccaggagtgaagcgtaagagactagctttcaccatgtttcttctccaggcgtttttcacgcagttcagcttttctcttagctacacgttcacgcagtgtaccgtgttctttctcatagcgcaggtgatgcttgttgaaatcacgcttcatacgaacgttatgccagtattcttggctggcaataaagatcgccgggcgagacagcctaggaacatcgtatagctcgaacatgcgcttcatttctttatattcggcatagttcataatacgatcaccgggagcaatctgattgtcccaaacccacttttcgtgctcccaatccgtatagaatgcccggataacgccaggagttacttcaatttcgtaccacgctgtcttagatacacgatcgtgatacagccctgggcgactgaatacggggtttcgcttctttttctcgccaatcatagaacgtaccgtctagtgcttgctcaacagtgcgtcgagttgccttgccccagatgtagaaggaatcaacaaggctagaacgaaagactcggataccacgtagagattgcttattcattatttgatctccaatgcgagaagatgattagacagcttatccagggcttccagagcagctttgttgttttcgctcaagttactaatagtcttctggaggctatcaataacaaagtcacggactgctaattcggcggcgattgcagacttactggtaagcccttcagcggtcattgcgttgacatgtcgggtataataaccgccagcgaaatccagctcgtcaatagcacgttcggcgtaatgcaattcattcagttcattgagttcgttcattgattactccttatccatcatttcgaggcgttctttgacgtataccagcctgttgtgttgttctttcgctaattctgctaacctgtagatatccgccactaactgcattgtgtggtcgtccataccttcgggtgggagtgtatctgcatatgcagtacagatagcgataaactcttctgtgttttccattgttactttcatcttggaaacctctctcatcaatttataaatctattatacggcaaaattggcatttttgtcaagtgaatttataaagaaaaagacccctcgctcaaagagacaaggggcttttgtttagaggtcaggaggtgcctcagtgttcttttctggttgttgacgatatttaaccgggatcatatcatatagcatttcaatcgatgcaaatgtgaatggtacccgcccattagatggggtagtcagtatcagcagttgacgcttttcatcgatttctatacagttagacatcttgacgatcctcttctaaggatttttgttgctctcagaacaatctggtttatttgctccagagagtcgaaggaaagttgcaggccatgaccttcatcggtggcttgtatgaataaaactctcttagaggcgtctacgaagacttgaaattcttgttccactttactctaccaaaaataattacaggacactggttttctctcgctatacgagctacataaccgtttacgctatgtttaatagccaagctaggctcgtcaaacatgatgcagctgaatcgacgacctatacggtaggtttctagcatgctatacgttgtaattttaacgtgaggttgaagctcactatacttcttctctaggcgtgccatctcacggacgccggatgctacgtataccgcttgaatgcctttaaatactgcaaactcataggctgtattaatagcctcaaacgtcttgccagtagctcgtcccggattgactgatagaggccaacgaaggtcaagttctaggaacctgaacagttggttgcgatctatgtacatgctggctccttaaaccaaacaatgcgaaaacctgtctcgtcctctagagcctgtacgatttgctctagtgtcagaaccttatcggacgagaatgtccagagaaactgttggagttcattccaagactcggcctccataatcggaacaccgatttcctggccgaaataatcatcagtaccacgaacgtcaatgcgaccaccggcgtatcgtttggcaaatacttttcgagttagttgcccaccatctgcaaaacgattcggctcggttacttccgtataaggaacacccatacggatgtaccaattgttggagactggccccataaaattggtgctataagtgatcatgatcactcctttaaactggcaaaccccaggagactcgaactcctactgcacggttttggagaccggcgtgctgtccagtaacactcggggaataaaattagctaccgtggtagacagatactgtcttaccattctgattcataacgtaggctacctcatcttctttcaggaagatatgctgatcaagaccagcaatagagatgctcttctgcttaggattaaacccaacgcttgaaccatcgtgaatttcttcgccaccgttaggtgacattaccttaactgttaacatttgcttctcctatagtttgccatctctggccgttaagtgacgtcctggctgatatagagtcgagttccaggcagacgtcggcaccccggactacattggctctagaacagcaaataatttaagagctaaacatactaagacgcagcgcacgtacacgatctacgcaggcttccatctcagctaagagtgagaacactagttctgcatcaaaggctttcattgttgtacctctcaagtagtatcgataaaatggccttaccggctcccagttccttgtttaattccccgcaacgtcaggggacggtcattttaccgaatttggagcgactagggggaatcgaaccccactcagtaccgcttggaaggcggacgctgtaacccgtacagttagtcgcggaattaatgggctagtctcttcacctcagactactacttgatcattacgatctgtcggtagccgcgagcatcgacccttcatatttattttacatctacagaaggtcattagatagattacttacaactacagccaccagagaatatggagccgtagcatctgtcacacataacatcttctatggaaagaatcttcatatgcttaccttttagggttgctggcttccggaattgaaccggaatttaatgacaatgtaaacttaatcacactgtaaccataaccagcgaaaatggtgccccaagtaggaatcgaacccacgacctaccgcttacaaggcggttgctctcccggctgagctattgaggcaagattggtctcccctaacgtgatttgaacacttgacctgacgctcccaaagcgcccgctctgccagactgagctaaggggaatttgtatagttatgggagaaggactcgaacctaccatcacctgtgcggaattacgagaccatttgcctacggaatcgaaccgtatctcaaccctagccaggccgacttccccatcagtcgtgccccataatttggtacccactcccggactcgaaccgggaaccctgaagtcttaagcctcatgcctctaccagattggaccaagtgggtgttaatcgttatccaggtaggcttctatagcctctaaggcttctagagtagagatattgaatctctctttaagcactaccactagagtttcctgattccaggaatctacggaattaatgtagttctcgatgaaattagagtaaccgcccattatcgaatctccagaccttggaaataccgcgggaacggagagcctacttcaaagctgatgccccagttgagttccaccagctctgacttatccaaaagcagatcattgccttcaaagatgtagccgtatacagttgggaacatcgctgccagatcctccatattggagtaagcattatgctcttcacggaattgctcaaactcttcaaagaacttctcaaggaagaactctggtacaatgaacgttacaacgtcagtgctgtcatcaatacggtagactgttgcctggaataggccgacaccgaccaagttgatagcaggagtagtaaagatatccattattaatataccttgattaaagtattgtcgatggtgttcaggaacttaactgccgcatctctattagagaatgtctccagcacgataatgttgttctcaggatcaccgttacgcactcgtacctggtacgatacgatcacttcccagcggaaccataaagctcgtggattatatcgcataagtaattttttgattcattaggtaagccctctcattaatttatattattatattataaataagagcgtttagcaaatgaattttcgaactttcgggaaaatgccaccctaagtcaatgccactacttgagacgttataggcaatctatctcaagttgtctgccccattgctcttcagtgatttctgcacgcagaaattcttcttgactggaggactttaccacgtcaaacggccggaaatcggtggcttattttatcctgtcacccatcacctgcttgtctgagtttaatcagagagcctgtaacgggctacttgggatttggaagtatcagttggattcgaaccaacgcaccagctaacctagagatcaccagacgtttccaagtctgctcactaacggccagccgctttaccatgagctttaggactattcagctccataagctattgatactatcaatttggtgcaaccggttcgatttgaacgaacgacccctggactttcaaaccagtgctctcacctcgctgagctacagttgcgtaattcgtgcctgctcctttgaatcaagaagtccaccccggtctttgggtctttgcagtacatcacgctgctctgatgtttggtggaacttgggagactacgtgttactcccctcacagaccgggattccccgctatccatgatgcttaaccgattagctgaagccccataatgtggtagaccgcccgggactcgaacccggaacctatcgcttaaaaggcgagtgctctaaccattgagctagcgatctatggatatgttattgttactgcaccgttaaagagctgtaactcccccgtattgcggaggtgagataattgaaagatatttaagttatacttctcagcaacttcgcccatagtggagacgtagaagttaaacccccttaccgtctactgttaccacgtaatctttatctttcataagtacctcgatctggagcaccatcatggattttaaccatgctgcgagggtttgcaagcctctgcctagtcactcggccaatgatgcattgtttaattagggcgcaccggagttccaccgattgctaacgcttcaccgcaacctaagtcgctgttcttaccctaaattggcgggagaggtgagattcgaactcactgtcattcgcttaacaggcgaccgcctataccacttactgcttctctcccaaatttgttacaactcaatgagtcccgcatgaaactctctgtgacatctacaacagagtggaacacacttttcaagttctgctatcagtttttctctactgaaattagagcctcgggcatcacttagtacaaaatctttttcgtttgggtctaaatggtgaaagtcaatggcagctttacacttatcatacccacatacttcgcaatctagaactgggaatacttcggctactatagcatcaaacctatcggctctatgagttagctcacatgttttgcacgttggcttccacttttgtttgccggatactggctgtttaccattagtccagaagttatctgttgttaaggggtaacttacgttacacttattacacttctttaattccatttctataccttaattggtgcactgaggtggactcgaaccaccgaagtcgcgatgacaagggatttacaatcccgcccgtttgccgctccgggaaccagtgcgtatttgaagaagctctcataagaacctcttcaaataccccgtcgaaacgggctatttgctaacttattgtgtctagggctgacccttgtgtctgaggatacctctagacggtcatatctcttagcccagagagaatttggcgcggctaacgggattcgaacccgtggctccgacgtgacaggccggtatgttgaccgctgaacaccatagccgcataatttgttattccggttcgtattccattaagtcgtctgactcacatgtcggacactcccaatggcattcacttaattcaccgcaatcggaacaaatgtacatttttacttcgttttccatttgcttttcctctttcgtttcaatataaatattatactaaatttcagagtactaggcaaatgaatttttcattaatcgtcttcttcgtcccatgagagggagtgcatgaagatcggtagaactgtaggttctacgtcaagcgacgggtagaagtaagttttaccttgagacaggtcaatgaacgtgggggttctaccctcctgcatgtgttcatcaaccttgtctagggcgtcgtttaacagttcgaagcagtcagtattcgctccgcaaacaacgataaaatccattaaccgacccccgttcgggaaaccggaggcaagcaggaagcgaacaa

SEQ ID NO: 640 - DNA, 8782 bp, Klebsiella bacteriophage F92/15
cttcgcccacgaacgtaaagcgcaggttgcgaaagcggaaggagatagctgctacactcggcttgctagagtccggggagtagttcggatggaacttgatctcggagactgattggtcagtcagatagttggtactcggattattcagggaatcgtatttcatcttaactccaagtttatcaatttactggagttattataccaaataatggagtctccgtcaattgaaaatttatggtagtatgctggcacggtgtaacttccataatccgtaactctagtaaccatgcggtgtctacatttttggtcaaccgttaccttcaaggtgacttctagcagtttgcataaagtaatcctgatggtctgggcaccatatttccaccagctgatttaggctgtggaacactagcttctcgtatccgaagaatactccatgagcgtctagagcacggttaataaagatgaggttcttagcgtcttgcctgaaatctggcctcagttgctttatcttattatggttgatcgaaccgtcgcgtttaaggaactgattaatggggaaggatttagcttcccatactagttcttgatttatcttctgtcgtaattcttccactactcaaattcctttttctaacctctcgtacaggtctttggactgaatccaattaaggtatactcgattaggttgattgccacccccacgttgagtaagtataaaacactctttcctgactttttcaacagtaactgctgcttgatctacggggttctctcctcgtaggtagttgtctatagatttcattttgtctccaaaccacgaaaggccagagcaattagccctggcctctttgttagatgaacagatccagaaactcctctggataatcggaagaatccccaaagtcgatgtgatctgcgttaaccgggtagccttctttcgtcttgatgccctgaagaacatgggccaatacgtcaaagtctacgctgctgttgttagtgcagcttgcccaggcttcctgacggtggacgcatttgccatccaccataacctcaacaccgtagccagtattccagcaaccgtactcgcagtccccagaatcttcctctaggaagtttaccacaacgcgtttcttagccatttgtcaccctcttagtgaatagtaccgtcgatgccttccatatggatatcgattgccattttcagcattgactccgatttatcaaactctttctttgaagccaagagagcttcaccacgagctttcccatactctgcaatagcgttcagggtatgtttcaggatatcgtcggcggataagccctgggtttgccagtgaacttgagctgtggcgatgttcaccataaacttactcagttcaacacgttcttcgtctagcgcctgcattacatgagttttgcagttgtagaaggagttcagacaaatgtcttcttcggtcagaccttcaaccagaagcatcttctctacttgcgccaggcgatcaagccacggattttggagcatcaaatttttcacttgcatggtataagttcccgtcgttaattggtgcgaatgattttgcattgcgttcaggacgttgttttgcaatccagcccaacatcatttggcgaggtagaatgacttcagtgtttagatacacctcgtaaatccagtgacgtgcgttctgatacttgccaaactcatatgctttcttgaacaagccccaaacgacactaagctctagcgtctctgcatttgcagtctgtcggaatggtatcactttagagccaatgagttctttcagagcggagttgatatcctgatggctgaaagtggtctcatggaactcgttgaagaaacgatagtccagggcgttattagcgttgacaaacatctggatgaacagatcgctgaactcttggtgctcacgattaaaatattgatttaaaacttcagttgatgcggccatcttcccacccgttaattgctacgagatacatctcgtaaatgaatacagtgactggttgaattgcttccatatagaacgtcgctgggacgttatggaagactgaaaccaccatggagaggaataatgcccaacctaggaaacggctggggagttctcgccagacctggaagttacaatccaggaagttatagattcgaagctgattaagcattggtcagtctccagtaatagtgacgagtgttaaactcgaaaggttcgttggtgatcttagtgtgcaacgtgatgatagtccggggagtaggactttgccagatctctgcgaaccatcacagtgttaaacggagcgccatcagcgcgttgtaccacaattgctaaacctaggggaggaagctcactcaaaggacgccatgagtccttctcagcaagctcaatcttggcgattagggcaattgactcaacgatatcttcatcacaaagcaaatcgtggtctactacctgacgcagagcatctactaacacttggcgttctttggagttaaggttcatttttcttccttcttaatggtgttttcaatatcgtccagcaacgctgtgcagttatcgtagttaactttgccccggccaaagattcttaaaacacaggcgtagtacccggttaacagaattgccagagggtacagaggaaccagcattgctgccttaatagtaccttttaaaccgaagccgtggtacttcccggacaggtagccaacaacaactaaataaagtgctgctacaattggtgagatcatttcttaatctccgtgatcaaccgcattttggttgtcttcgacattgtggaatcctggctgattatctcttcgatcttcgccaggcggactaaaagtcgctcagccgcagcagagaattcatcagcatcttgtacttgatccatcaacttctcgtgtagcccgttgttggttaatctcattctccggttattttcccgcagtatcgatacccaaaccgccagacccgttccagttacgagggctgctattaacagcccggatagaatttctagtaccatttactttttctttcgccttttcacgtttcaggtcacgttcaaagctatcagcacgacgctcagcaacctgctggtgttctttggcccaacgcgcttcatttttagcgaggttgtaggccgcagcatttttgttagtaccttcgtacagagcacgaagtgccgggagagacagtttagcaagctgaccttcgaacccatccatatccagcaggattaccagtaccgcaaccatttcgtctttggtcagggtgttagcttgttcgtcagcagttttaccagtggtgtaagagatagtgttcttagccataatgatttccgtccgtttcgttaatttatgcgtatattataccgaaattctaactacttagcaagtgaatttttaaactttttaccaatcgatccggtaagcgtaaacttcagaatgaatgtgctcttctaccagcttcttgacctctggccagttcttttgaatctcatccagaacgtagtcgtttgaagcatcatcccactcctcgggaagtttcatgaaagagcctgcatactccagcacactctctagaacgtcagtcaggtaaactatttccccacgattacagtaggcgtgttggtaatcccgacgatcttcgttaaacggggagtcgctgagataatctcccatatgaaggagttcatcggcgaactcctcaaatgccttgacacgagcagacagcggtatgctttcatcacgcatcagcaggttaaaagaagcacgggcgacgttaactgcgtggcgaagggattccatatttgcattcagttcgatcattgcgtttttcatatttgcttcctcatcaatttatacagctattatacagaaaaattggctcggaagcaactgaatttaaaatacaaatgctacgagcgcccagattccgcctacaattgctgcaccgactaacgcagctaggattaagaggccaataaacattttggtccatatcatttcccattccagtatacatggttactcctcgattaccagtcttctcatgtagtcgttccaccctgcacagaatggagaaataccccggagtagttctgtagactggtgctgcttatagtgatcttctgcagccttagccccacgtttcttctccgcccttttattaaactcttccagcacgatacgtccttctagagcttctttagcgataggatactccggccaatcctcctctaggacgatatagttcgggaatcctaccttaccgtcagcttcccgacctttaaaaatcagagataagctgtcgtttatctcccgaatagcagtgctggttagatacttagcggcatctgactgcttaaatacaatatagcgagattcgagtttcatgatttacctcaggcagtgaatagaatgtcgtccagtaggtcgcccattgggcgatctttatggatctcccagaactcttccggttcccaggtttcagtgtccggggcaaccagaaccgagatactcgcgtcatctgtaaacacggagtttccgttgtccagcattgcgacacatttctgcaactcgaaaccaccagcaactacgaatacttcaccttcttccaaatctttgaaaagtttcatgcttcacctattaaataatgtcagcggaaccacagggatcatcacgatttgtggtgaatgtatataattgacctagaaccggcgacgccacggtcatgcgaccgttaaaggtgccacctgtgtccagatagacacggttcttccagcgaatcgggaacggaacaccagtatggccatgaaacacgtagtctactcccacgatttcaggaacatcgactgcgcactccttggagaagctagagtagcgatcgaagtacggatgcttctccccactacgatacaggttaaacccaacctcttggatcacatcacgatcccacagcagtacacccaaacgatgtagaactggggcagactcgtgttcatgcacaatgtcgtcccacacaggtacagttacacccataccttgagcctggtaacgcagagggataccagcatgaactaccccgtaacgcttgccacggtgttcaactgtcatcatgtacggcatcttgctgtccatgtcttctgcgatgccttttagggtgtcggtgtcgaaaccttccgtgatagtccagctaccgccattatacatccagttggcgtagtcgtcttggatcatgaactcatcatggttcccacgaacagagcggaatttcgggttgtacaggaacttcgctagaacctgtaagttcttcgggccacggtcgataagatcccctacgcagaacacgtagtcacgaccttcttcatacccagcaagtttcagggcatccatcatcatatcgtactcgccatgaatatctccgatgaagaagatattagcattatcgggtacggtaactgtttcatgaacgttcattaatacctcgtctctaaatagtaacgttttggcagtgagaagtctgtgggctgctgcctgtgatctcttacatattcccctcgataagggtcgtatattacgtattgcactagaccttcgggttcccaggcaatcagtatttcattgcctattcgtttaaatgcgtacccattctgcttagcccacagtatgcacgagtagtccaggctcctggcatctacctttataccagaaaagcccctctctacattgtaggtgataccctttattaacttatcaagctgtattttcttattatagtatgcagcagctcgatttttacgggtccatatcagaagaccagtctctagagtaatttttgcatttagcactccacgtcgtcgtgttcatagccatagttagtgcaggtgttagcttcatcatcgtccttacagaatgcaacgtagcagtctacaacttcccagaacgcttcgttgatcagagcattttgatgggttagatctaattcatcccactcttcttcgctctggaagtccgtatgtacgtgagcatcacaacctacagcgcctagagatacgacaataactaactcgtcttctaccatttccacgtaagcctctgcgtactcccaggcggcttcattaacaagctgagtcttctgggcagcatcgagagcttgccactcttcttttgtataccccagatcaacgaaggtagtaccaactgcaaaaccgttattcaggataagatatgcttgcttagtcattatgtaatcctctctcaattcaatataaatattatatcaaaattttaagcgtttagcaaataataaaaaaccccggtactcgtattgagccggggttagggtattattattctacgtagtcgataaagtcttggatagctttactaactaccgcagagcgaagcgtggcaccactcagaatgtgatgtgcctcttcacgtccgttctccacatccaccaggactactgcgggtacagtgcgaaggccgaacttacgcagggaatctacgtcgtccgtgcgtttttcaacgggcaggttgaactcagcggtgagcttatcaaaaacaggttcaaactgcttacaaggggcacagttagaacctttaaggaatacaatcttcttaggcattattaatactctccaatagtgttttcattgtttttacggttgcggtatccaggtctagcttttctccgaaagcttccgttacagcttcctgatacggctttttcagacgaccctcaggcactgctacttttttaacatctcctgccttgacttttgccaaaatagtagttaaagttggcatggaaagtttttggccctcaatattaacgccgagcagttcggttagcgcattgttaaggtcaattcgggtcatttttttaccgtttggacataacaccctccgatttcttagcaattttcttaaactccggtgactcacgatcccgcagagctatatttaactcgtagggagctaccttaaaatgctcgcacatctgagtgtagaatctgtccgacattttgtatctcctctctcgaatttataaatatattatacgctaaatcgagcagaaagtcaattgaatttttcattgatcgcagtacttgcctcgtcttacgaaaaataagtgtaatggggtatactgagtacatcaacacaggagaagtaagagttaggatagacgtcacccctcctgcatacatcagcggtataaatgctagcgttatagctaggactatcataccgaataacaatgccaaggacaatgagaagcaattctctagacctaaccagagccagcaaaaccctgtccctctctttttctcacatggacagcgaaacacaccaaaaataccaaatacgaaatgtaggagccatctagcaaccctagctaagcgtgttctgcgaaaataaatggcaccgcgtattaaaatccatgttgcggaaaagaatactataccaaattgaaatatcttgagtagcattatagttactaaacttgcaaacataaccacctcctatttgcttgctccatacaaagaaggggagcctaaaagctccccttaatgtcacagtaactctacgtgtccgccgtcatacgttccgcgttggatttcatcacggtagtcgccagagttgttccaatccgctccgaaacgaacggcgatgttcatttcatttgcggcctttttaaatgcaccgacaatagcccaaaatgcttctaagtcgttccagtcaatcttaccattgatatacggagcgaaatcaatggcctttcccgtaacgtgcttagacttgctagggtcttttaaaaatgaggtgccattggcaatattctgggcactctgttgtacagtacgtttgccctgaatgatggtaaaatcgtgtggtgagagttccagagcacgaatagccagagccttaagtttaggatctacagtatcgagctgctggagactacggtttccaaatctgaaactcatattgatctccctagtgatctctgcggcgatgcgcagatttttgccatatagtcattaaacatgctcatgtcttcgtctaatagtgggtatttctcccacgcgacggcaacatatccagcgtagatgttattaaggttaaaatatgggcacgtgtacacatactcgaaatttgcactcttgaacggtggcaaacccgttccagaccacttcgataaacctcgtttttccctttgcatcaattgcaaagttcagaccgtctaaatgcgctcggtagagcatagacgtcttgtcaactgctttgtcggatacatcggacttatccaactgaacgttgctttcccaagctatgatagtttggtaatcatttatagcctcaggcttgtatttaaccacgaagacggcatcagctcgagtctgtgagaataggatcattgccttctctcgtgccacatttggaaactctagtgtgcgttgtactttaacatcttgtaggaccgccgaagtagagaaagtcttcaagtacgacatgacttcactcgtattagctataaagaggtagataactagaccaaccagtaaggttagcaaacgtttaagaagagaagctggatccttcgcttcttgtagtaacagcgatatcaactgtataaatttatccattaagaacctcctctaaccatttataattataccctttattggaggaagttgcaataaaattttatagttattgctcggatcatactttgggacaaatgtcaagtagaatttagaa

SEQ ID NO: 641 - DNA, 8256 bp, Klebsiella bacteriophage F92/15
cagcggctctcgtttaatatgcgagttctgacgcttcgtctagtttctgcacgtttgtgaataagtatccagctcctgtagcagtgacatatcatcaagatctaacttagcatctttggtgacgcggttattgatcttcttatctaacagttcgctgttctttaacgttttgagttgcgatacgtcgccggtgacttcgtatataactctgtcatacgcatcggcttccattggctcgccgacttcaatagtttttcgtatgagctgtggaagatctcccagttcaacccacgaaaggtagtgctcatggtctcttggcaagaccgtatcgatgataaaagctccgttagttcctttcgtcctttctctgtgaaacgaagttgtaagcggagatccggggtagagcaggtcaacatccccgatcttttggctgttcttgtagctgtgtagatcgcctgcaaatactttggagtacccatgttcgacgaatctttcgaggtcgatttctggtacgacatgaggcgggattgcacctctgacatgcgtgaagcaaatgtctgaaactctgggcttccaactagctttgtgaaggctgctgtaagggatgatatcgaactctggagatcggtagtctttgacgactttccaaagcccgtcggttgcgtcgctaattgctgctgcatagtgatccaggcaagaaatcgttttagatttcatttcgtggttcccggtgtaaataataccaggatggtggagagtagctaggaatgcgaacagtagttcaacttcttctgaagacgggtctgaaacatccatgatgtcaccaccaataatgtgaaggtcacatccagtagctccaaacacttcgtccagcttttcaccgagaagaataaaccgatttttctgccattcctggggaacgttcttcgcccctagcttaatgtgatgatctgctgagaaaagtattttcatattcaaaataaaagggagccgaagctccccttgtttggattaatcgaggtcagaagctgcttcgtgatcgatgttaccggagtttgcggaaccttcattacctttagattcatcgccctcctcatctttcttaccttccagccatgcctggattgctttcttctgctcatcataggacggaaccgggtaggtaacatccagtttaggctactttttcgaagccttcgaattcgtccgcttcgttatacagagcctcgccaatcagagcaacgtcggcttcatgcagagcggcctctttagaacccggctgtatttttagccatctggaactgcatagctgcgatctgctgtacatcgtacttagtatcgaaaccagtaccagatttggagatagtgatatcgatctcacccggatcttccagattcagctgggccatgatggagtggataccagtcaggatggttgccttaacttccatcagcttcagtttgttatcagtacgatcgataacaacggccaggtagtttttcttaggacgcagcggctgagccttaccatctttcttctccggatctttgaagcccatgtcatgaaccggatcggatgctccacggatgaaacgctctttctcacggtcgaaacgcaggcactcgaacggagccggtttaccttctttgttctgaatccagtacacataacgcgggagaacgccggaaacgatacgcacaacgttcttaccgttgttgaacttcatgtagtccagtttgtcgccgttagaaccgccagtagtagaaccccaagatttagtagccatatttatttttcctcgataaatgtcaattttgacttgttgattgcgattagtgggtggtgctcgataactgctctaggaacccacggcggaatatattgcatatccagtgatgtatccttcgagaagctatattcggcatagtttctaaaactcaaaagtcctagatactcagccaactgtcggtctgacagctttcgtttattataaacgattgtatcttcgttcaagataaatgatctacccgttaacatcacatgagcttcgggatcttcaaccattcgtctgataatctgtacaatcagcgatgagttacctcgcgctaatatgttaaattttttcgtaatcataaaacaacatgattattatacaccattttgagagaatttagcaacttaagttttttatttttctgcttcggactttccgaagattcagttgctgttcccattaatttatacagatattatatcgttatttttgaggactcagcaactgtaaatttttaactatttgcttaactcttctttgtaaatctgtctctcaattcaatataaatattatatcaaactttggggttcttagcaaacagaattttatctaagtttaccatattcttctcgttaaagtcaagaacttcccacccattgagacgatataccgcttctctacctgccgcctgcttgaatcctacacctcctagcttcagatccacgagaattgggtccaacttatcatctgccatacgttggacacgacctgccaactgttcgattagagattcattatttattaaagagcctaacactaaacacgataaagcatttaatgacacaccctccgagaagatgctttgggaagccgctaatacacacggaccgtcattggtcacgtcaatctgtacctgctccctatcatcgagcgaagttacaccggtaatcgtataggtcttcacacccctgagttccaaagcattcgtaactctctcaatcagatctatacgatcggacacaaacaggactttatgacctgccatcgaatataattcgcacaagtcaacaacctgttgaaagtactctggctgcgagtatacatcgttagcccttatcgcccacggcacattcatatttccagaaacctgcgtttttagcgcaaacctatggatagtaggaggtaaagtgttatttaccggaggactatacactttcgttccaaaatagtccttaaacataacctgtaacccatccttacgttttaacgtaccggatagtccgattttatatcgtgccgaggactgctctagaaacttggtgaacgtggtggcaacacagtgatgcacttcgtcaacaataacggtgccgaattcttttgccaaagcggctccgtgtttgttaactgtctgtatattactaataacgataggagaatcgatattaaatttgccagacccaataactcctggctcaatcccaaagaacttgcgtacctccttctcccacatagctcgaatggtagtgttggtacatataacttaacgttttttgcccaagtttatgggcgatagcaagagcaaggattgttttaccgaacccaggcttaccattaataatgcacgtatcgttacagtcttcgtatatagggagctgatcccctggtctcagggtaaacgatggctttggaatatcaacaggaactagagtacgtttatccacgacctctgtcactttttgcccgaaagattctaggagatctaatctggttacagggaaccacttgatttctttacctactgatcctgagttctggaacattagaggatacttcgccccaggtttaaagatctggtatgaagtgtgttttaataagtattcccacagttcgttgctgggtttacaatagattttattagatataactatcttcatatcttaactctaagtctaggagtttctggctcctcttcgtgcgtatcaaaaataactggtgaaccgcgaaccaacgcgtacgaaatatagttggcaggttcactaagtaagaaaggatatggaacgttcttgacataacactggtactttccgttgaagattctagttgatcctctaacgcgttccgtgataatgttataataagttgtaggtttccatgttactatcttacctgtggagtcgatgaaatgctttagtccagagtttattatctgagataagtacttgaactgtttctttaagggatagagcttgtaaggtaaattttcccgctcaccataaagaaaaagccttcgctgagagaatgtcccaggaaggcttggattgtccagcacataccttgtaaatctcgtctggataacaatgtactccccctcttggaagagtacatcataagcccttaaagcatatactggtaagctaaagttaagcaccaagaaccctgcgaacgttgacaatatctttgctgacttccggcaagaacttaatattggcgtacttatcgtgatcagggtggttttcatcgttagccgcaatagcagcgtagtcgaagtcctccataccgataatactacgtactttctcctcgaactccttgtcctcaatgcaagcaacagaaggacgctgtttcttgatcttaccacaggagtaatcacgagaaccgccagcttctgagtcagagtcgataccaataggacagcccgggatactgataccacggtctacctgaatgttacggattagcatctcgttatactgatcaactaaatcctcacgaacaatggcaaccacggagtcgtgaaccagcatgataatcttcatttcgtcctgcagacccagagagcgaatctcattatcggtatcgatagcgcctagcaggagactatcagaagatgcagactgaatgatggcgttgaagccagaacgcagttcttcaccctgtacaccacggtcttcggagttaatgttgtgcagacgacgcttacggccaaagtggctgtaaatgaagccgttagtctggatttgggagtgagatttatcgatccatttcttaagctgagggaatcggccaaagtaggtttcgatgtactctttcgcatcaccagtagtacattcagtatacggtttacccgtcttcatgtgctcttctagcagagcttcgtttactgacgctgctactttagccgggccagaaccataaagaataccgaacgaaatcgcttttgcagcctgacgcagtgcaggatacagttttttaactttcagtaggtttacatggcagagcaaataccatgtgtgcaatcgaaccgtggaagtccgagtagttttccgggtcgttctgcatgttgataaacacttgctgcatgttaatgtcaccagacagtacagcggcatagtagatctcagcagttgttaagtcccatgcgataatgcgataaccgataggggcaacaatacaacctttaataacagactcatcacgaggtagctgctggaggttcagcttaccagacgaactcagacgaccggatgtagtcatatggatatggaatccagtacgaatgcaaccgtcagcatcaatactgatcagcatcttctcgatatacgtcgagagcagcttggagatcttacgaatctctagtagagtcttagctatcggatgctggtccgaaagctctttcagggcatccgcgccagtggaatctgcacccgtatctgtcatgatacccgtcggggttagtccaacataatcgaacaggagcttacgaagctggacaacagaggctgcgttaaacaccgagccttgatcttcctctagcttacgaacctcgggatactcgtacagcttagcctttgcaagctgtagcgcagtcattaactgaacctgagcctctttcagacgatctttggagatcggtacaccacggtcttccatgcgctgtaggaatacacatcccggcatcagtacatcgtagtacagagacttcagtcgagggttagcttcgacttttggcaggaagaagttggatagacgcagtgttgcatcggtatctttcgctgcgtaaggccacatgatatcaaacggaatgagatcatacgagaaatcctctttcttgatcttatgcgtcttgcaatacgtctccttgaactggtcgagttcaaaatcgtaactcccccatgtcagtatacttcatcgccaaagatttcaaaccgtgtgtaccacgtcgttcatctagggcgtagtgcatcagcatggtatcatgaaggcgtttctcttctgctgccttatcaaaggataaacctaagtggtagcagtagaagtgcatatcaaacttcaagttatggaacacaacgccatgttccgggctatcgaacagcttctgtaagtaatagacggtattttcggtgatgacgtctgcatcaatatacacgccctgatactcttggtgggagattgagatccccagcatgtaaccatctcggcaatacagcgcactggtttcggagtcatatgcgatcataccgggacacatggtatacaccatcttcacgtatgcttcggcttcatccgggcactgaatcgggcgataatcacctgctttagagcgtttttcacgaccattgagaatggcatggatgctctctacggtagcctcaaatacgggcttcatttccggtttaaagtggagctgggccggactgatacttgcaatccagttagcgtacccgtcatgctcaacacgtttacctgagtaatcggaaatgcctttcttagctgcaaacttcaggaacgggtctgcacctaccagaataacgtaatcaaaatcttccggattgaacgggttctccggcgttccgatagtgatatgtttcttgagcagtcgcccggttactttctcactagccatgaagaaggtttcaacttcatggtcaaagagttcgaagtgtttctgatagcggacgttattcggtgatttgtctacaactgcaattttcattgatttctcctattaggtaagcaagtaaaacgtcagtgtttcttctcaaacttacccaattattatatcaaatcttgacatgttcggcaatcaagatttctacgtttctgatgagctggtcgacttcttcagcatctaggtccccagggtctttgccctctggaagcaagaagttacctataattggtataattctggtcttatcacggattaatttggccaatttcttagatgcctcgttaccggacttatcattgtccaatatgatgactacgtgagtcgtacctgcaatttggaacggcatgaatttatctgctatgttatctagagagaactggtgagtaccaaaacagcaggaaacgttatggcaacctttgtcttctagattcaacatgtcgaatataccttcgactaggattagggctggggtgttatatcgaacagggaagattggtggggagaccttctttggtctaatcatatatttcggaggggcagagctatccatattacggcctaagaagaataagtttctccctacggcatccgtaataggaaacactacacgaccttcccagtcctctgtttgttggaatgcaaagtactttttgaaagtctctgctttgataccacgaaagtcttggtcgaatatcatggctgattcaggaatttctagactgcgaccctcagttcggaggtcactaatcattctacgaactttcaggagtctaggggacgtcctgtactgttcttcattgaagtaatgaaagatgcttggtataccacgaccaaatccgcagcttaggcagtgaaaaaccccggagtcggggtcaacacgcaaactcggatgagcatcctcatgatcaggattgagacagcggatgaggatgtccccacccgtatctctgtattcaatccctttgagatctaaaagctcggttattctactcataagtctcttgaggattctccggtgggattagtatcctcatccgaagcctttttcctttttggtttgtctttcggtttatcgctttcaagtgggataacaaactctgcttccatctgacgaatgtcctctagtttaagatcagaagtctgatccatacgtaacgagttccagttgatcttcggcatgaatgtcataccctcggagttacgagtttttacgaagtcaaacttgattgcaccgtcatgcccctcgttctgtttagcggcatttagatttgcagccatatcacaggaatcgagaatacctcttgccatgcgggcgttaccctgttggtcaatctggtaaggagctacaccagcaacattatgcttttggcacgtagacttgaatgtagaggagacaaccatctgctgcttccaatcatacatatctaatgtcttcgtatcaggcaaacgtacctggttgatatagtctagcagggcgattgttaccttgtccccactacttggaggttagcttagttagttcaacatcga

SEQ ID NO: 642 - DNA, 4834 bp, Klebsiella bacteriophage F92/15
acctgtattgctcttaacgtcagacctttctcgtttagctcatctggcccacagtcggataccagaatagatttctcccccatctctagggacgtttggagagcaacccaaatactagattcatccgggaactcatatgcctgagcatcagacaacatcttacgatgatgtttataataagagaccggcttgtcaaaatctatgagagatccatatgcctcaatggtttctgcactgatatccccgtcagacaggataacgacttttgcagatagcagaatttcacgaagaactgagatacactcacgacgttgtttaacaactggggcgaataacaggtcattcataactgcgtcgcactcatcgataaagataacatcgatctgtccaacaaagtttttaaacttgtggattgagtgaatagtagtagacatacgatcaatcgcaccgcgtttgaagtttagcatatctacggacttatcatactgtccggcttcaaacttcttggcattagatgaaaccagggcacgtgtgttcgtaaccgcaaggaaattacctttcagctgaccacgttctagccacttagtcactgcggtggttttaccagtacctagggaagccttgataaacgttagatgaccttccggtggtggacggttgatcttcaaatagttcatcccatcggggctatcagaggtcaacttgtgtactggaacgcccttaacattagactcaggaatatctcgcatagagttgttcacaaacgcttttaacgcctgcttacgcccgttattaaaatagtcctgtaggctgcgggagttatccttcgtgttaatataatcggataaggccgaggtaatctccttctcaagccatgcgaaatcaacaccgtcctccagcgctctgtggtacagcttaggaataatacgcagataaacgccatcgtctgcttcttccagctctgcaatagtttgttccactttctcagaggctacacgcttgcccttaatctgattgagtaaagacagaaattcttctttaaattccccacgagtggcttcgtaatctggcatagtgctgggcagttcaatcctagcgccgttaactttaaccagacgtggcttaccctccgctttaaacggatcggtaaactgatcccggaaaatcgggtcagcgaaatagtgtagctgtacagatgaataataagctaagtcggcaatatcaaaaccatacttctgccgagagctatcgttgagggacgtaaatagaaactttaactgaccctgagtaacgggaatattactctctaatagcatgtgcatacgaatccccggcttaattccagccgaagacgacgcatgggcaataaaccctgcgttgagcgggaacatgtcctcgctaatgctatttaataacttaataacatgacgtcccatccccacgatgtcaaacttgtcgcatcctccggtatcggagattccatcgacgtccatagcaataatattgctcttatggtcgattttgaagttagtacgtttacgacgcacggccttctctgcaactaagcatgtacctcgtactgctacgaggtgtgggtcttgagtgagctgaaccatcagctcatacgcttcattaagattttttgggtcaaccgtatccactacgttaaatttgtagggcattgaggctggcttaccttctggatgctcgtgagaaaactccttcgcaaaaaggtaatcagttgtcttcacttccttccaattgccggaagcgggatcgcgggaaaaacccgcgtgtccttctagaatagaaaacattacgttttctcctatgttgaagaataaagcgatctcgaactatcaaggatagaacagcttaaaagtccactgactcaacaaatttccttatagatggaggggtggtcacttcctcattgctagaactggccgcttcgcacaactcccacacagcatgtaatcgccgctaagctccatgtggttgacccctattcgtcgctattgcgcagaggtacgttgctacttacagcttcacttcttggtcatttcagaccgcggtgctatttgctccacatgactaacgaacaaatatctgagagcctcgcgatgccaacctctcttacccgcattctagatcaattatctataattccgttcggaatcaatttcccaataagccaaacccaaccaagcatgtagcagccggactgttctgtatgctcggaagtgaatgagaggaattatgtcagtttcgtaactcacatcatttctctcaacctatgaatatattataataaaaatcgtggcgagattgcaagtaaaatatttaaatacgtggtaggtaactgggtttaaacatataaaagaccagaggataatcccctggtctaagtgttcaactaggcattccaacccataatattaattgagttagaaaaggctattttgtttgccctcacgaagaatatctggggcatacgtccaaggctcgtcagctaccaagaaccccggagaaatacctgcccccggttccccggaatgcagcaaagttagaaggatggaacacaacgttgttcaccagaaccattagccccaagtccgagaggtcatcccaatcaaagaggatctcataatcctgggccaaactacctttggacaaaccaacacacacgtcatgctggatgatgaagcaaagctcctcgtccctcaacgcggctcgcagcagattctctgctacatcaatcaattccttggggatatctgcccaggagatacgttccattttaggaatactcatttagtcaacccttcaacttggaaaccgaagcgacgcagcacctggatccaactgttaatattttccggagcgtaataatcttcattacgtccgacccaaatacctgctgaaacacctgtaaccccaaccgggatataggactcacgcagcagacacgcgtagcctagtgcaaacaccagccccatctcagttagatcgccccagtctaggacttcatcttgatcttcgtccataggaacccatagccccaggtgcatgttgtcataatcgaagtagacctccacattatcgcaccacacacgaagatggtccagcagagactcttttacgtccagaggaatttcagcccagggaactagcccaaccccttgattaacaaccttttcattgaccagcatattcttctcccatttgaatgaattcgtgccactgctcagagtcggcacggaggatttgatagtcatcagacaagtgactcatgtcacctatatcactgcggtagcaccaactaccattgggccataacaggatatcatcgggatggtacataaattttctcctccagccaagcctcaacttgacctatgaaatgtttgttgctgaacacgttagcagcagtatcataccagacagggatcccacgttcttcgtacaaactctgctctaggtagttaataccgttgtttaccacccacaccttagtacctcgactatgggccgggaatagttcccaattaaagtcgattacttggttactggcaccaacaacgattaccagatcctgggttgtcagagtatcaaacaggttgatctgccccatgtaccacggagcggtttccccgaagaacgtaatcgcaggcttaacccactcgtacttacggtaatcaaccgcagtgtacccgatatcttccacgatcacatctttaccacggcgatacattatctccgtcaggtagccatgcgcatggatcacatcatcatggggaatgccagcacgctctagcagatcatccacgttagtggtgaagttaacgacttgaccggggaagcgctcataccactcagcaattctcaagtgagcaatgttaggctccaccgtacctagctcctgccgcctcatgttgtagaactcatgggtcagttcatacaggttacgactaggctcgtcatcagtaccctcagaaagggcttccaacgggggcataggatcgtctaaatagtggaaccccttatcaaacgcctgaatgttgcacacttcagttagcttgtacttatcccacagtggagtgacagcacctttacgaaacgtggggactccgctatctgcactcaatccagcaccacttacaataatcaatctacgcatactaaatccccagctcttcaaacatatagtcatcggccaactttccggcaggaacagacagacactcatccgttctagggtcaaccttagctttagccatccaagtattcaccaggcacagtttacgaatatctttacgggagatagagccgttagccccagaatccatagtaaagtaaatacgctcaccatcacatttatgaattttcataacgcctccgtttctcaattacaactatcatatcaaaaacggaggtgtttagcaagtgatttatttcaaattcatgtgcttgacccgttgcattacttcctgctgcttaccggggttaaacggcctgctacctggactgcccaaatacccacaaacgcgtcgggtaaccgagatattccccgacccacattgagggcatacaaagccgtgctctccggatacggattcccctaggtacccacattcctcacattcgtcaactggaatgttgacccctatgtagtgggatttacttaacccgtaatcaacaacccactctagtgcagagataaacttacgcatctccggaagctccacgaaggatatgttacccccattggcgatggtggtaaagttagcttcatagtcaaacttcacgttaggggcaacttttgtacgaacat

SEQ ID NO: 643 - DNA, 3981 bp, Klebsiella bacteriophage F92/15
gcagggagaacatacggaataggtgaggtacatcacctttagggccaatttcttcctctagcgggaaacggacggattaaggcatcatactcttcatcggagatgatcgacatgcctttgtagtatgcgtcttggcacagcttgataaattctttaacgtgttgcattatttggcctcgtagtgttcgcacagcttcttggtctttccttcccaattaaaatgttcacatagtgcttggaaagttgttaccgttctgcctagcgatttagggctaagcatttcgcatagtgtcacgttgttttcaatccacgccccgataaatacataaccgggtagggttttcttttgcttatcctctacccactcaagcgtcatggcctggaatttcaggggaggagcactgtaggcatcgataattattcttttcatggcgtaaagcctcgttaacaattctagacatgtgtgctcttaattgctgagtatgagcatacgtcttagcagcttcggtcagcttattaaccaactgagcaatttcatgatctttcataaagatctccttcaaactatgagaatattatatcaaggtttaaaacactaagcaattgagattttaaagtaaaaagaccagcaacttagtcgtcactggcttgggtcttttgagattcacggtaaacttcatgaagaacctctgaattgcttagtattttagtaaacgccctgaacagcgtgctagtcatttctagcgtgtaagggaacgagaatcctgatttagtagggaaccagttatcttcaatatccagtaaccataatcggaaaccaaagtataaattgcctctaaactccgagacagtcatacgaatctgtcgcccttcatcttcaaagataacgtgggactgatcatcaatatgtccttcgtaatcctgacaaatgttttgattcatttttattgttctcagataaacaaaaagcccccgaaggggctgattgcgtcttaacgacctactggagtagctcgatcaagttcttggttgaggctggtgatgcgcttaatattcgcaatcggaatatagcggaatttatcgctagagcggctaaagaccaggatatgatctttgtcagcgggttccaggccttcacggacgattcgctcagccagatatttatcttgcttaggatcgaactcagtcgtaccgtagaggtaagttacccccttggtacgcagtttggtgtattgcatgcaaaactcaccgtgtttctcacagatagctacgacttgtgctttattcattgcaataccctcttatttagtgattttacggatagcttcagccaggtgagaggcagctttaccggtcagtttgtcaacgatcgattcgtccaggaagccatcttccagtccagcgtcgttaaatgcggcgcgcagttcagcctgagcatcagacttagaagtacggccaccagctttaggagcatcaccaccagttttagcggtagacttaccagcttctttcttgacgtatacgccagctttggacagcttcatacgaaggccgttcggagaaacaccgtgctctttagcgatctcagctacgatctccatggaaacgccaggacgttcatcttccgggaagagttcgattttggcgacgtaggcagaagtcagttcagcttcgagttcaggagaccattgagttggagtagacatatttattacttccttatttattagttaaaaagtagtttttaagttttgtttcaaactatgagaatattataacaagttactgagctgcaaagcaaacagaattttctaggatttggttaacagctaccaaaccattgggggacaaacgatacatcttcagcaaaccacgatcgtacttggtgagccagccgttatcttctgcttcgtccatgggaactgcgtagtgcagatcccggatagctgtagcaccttcggaatagatctggaataagttcaggagttgatatttactcacctttgcctctcttttctaatttcagggctgcttttacagcgttattaaccagttcagctacgtcttctttgccccacttgaaccccagggacttgatatcaacaccaagtgctaccagatgctcaacagacgccagatcccaatacatatagttaacatattgctgacgggcttcggatagcaggtaaacacgatatgcgcctaccggattatccagagcttttttaacttcgccgatacactgatatcctggaacccaaacgtgttcgcccacttcgaatacctctttcattgattcttctggaatcgctggtgggaagagtgggtcaacctcaccattaacacgaagcagagcaccatgtgcggaaagaaccattctaatcatgtttgcagaacggtagaaacgctcggcgattgcctcaaaactatcaccggacaggtacgaatcgataacgttggccagctcagccccttcgattttagtaccacgttttctttttacgcatttcggcagaaacacgctggttatctttccactcctcgatcaaacgctccatcgtggagttggaggctactccgaggatttcgcaagcgccttttttggtcttgccatcttctagccactgaatcgcttccttaaacttttcgtccgggatgctattcgcatgaagttttttgcggattgccatgttctttatcctctctcgaatttatgaaactattataatacagatttagcttctaagcaatcgcgattttcatagaacgtagggtcgaaagtaacgtgcatgaattcagataggctcttgtaccccatgttaagttccatgttaatgcgtatagaaaggcgtgtctttcgctgagcttctagccaatcatagatatttggcatctgtgctaaacgaatgggtattaccctacacaactctatctctttagctttccgtgttttcgtatcgcgtttgggaaacttccttgtctcccagcgggcatcacgcttgctcattacgtactccaagttcgttttgcgcttcatcggccagcgccttctcttcgtccgtcataaactcatacggtacagagataccctcgatagaacagtacgttcgataccagtctacgatctgttccgtctccatttccttattaatacccatttgggttaagtacatacgggcatatttagggttggcagactgtcccgttctaataaagaagtccttcttgtgtttcttcagagcttcaataaaggggctaatcgtcacgttagaacacttcttaatatccttccagaatatatcttgaagtttatggaagaactccgcccgtttgtgtggtttcttactaatccacatctccgcatgttcctgtgtgatactcttgatagagtccaggtggaaatacttgaccagcattagcttggcttcgtatgcgtccgcatgacggggtgcacaccaatctggagtactgctcaaaatagcggaaactcgctcggcagtatactctgcggctgagctatcaatcttaccccagctttcactgaagatatcgatagttgctccctgatccagcagataatatcgcaatgtgctgataaagttacgggactctagctcacgacgttttacatacagctgctgggctaattctagccaaccctcatcgatgttatactgctccgaacccgcagagaatccgctggtggacttatcgatgaaatagaagatattcttagctcctcggtcgcgcctgattgcctggaagcgcatgttcggcgcctggttagctgtacgagtaataacaaatacgttgtcgaaatagttaaagtcaacgccactcgttactgacgggctgcacagtaggcaatcaatctgctgttcaattagctcattcgttgtataatctaaaatacgacgaatatctaagtcagatgtagagtttgagtgaatctctttaacaatcgcacctgtattgcttctt

SEQ ID NO: 644 - DNA, 3458 bp, Klebsiella bacteriophage F92/15
ggttagcttagttagttcaacatcgatggttgctgtactaagttccggatcatacacaatgatcatcggagtgtgcaggggtctttcctgcattagcatagtctccatgtcatggaagtcactcatctcgttgagcgtataacgtgatacaaaatcgttatatacttccagaccgccttcaaacatttttgtcacgagtcttcgcaagtttgttaagttcaataccttgtaaggagtcattgcgcatagccttagctgaaacaccggccataatggctaggttacgtctaaagacctcattttctggcatttcgatggagaaatatggggcgatatccccgttgtaatactgggctacttgaatgttagaacagatgattgatttacctgtaccacgccatccaccgagtagcagtgtttcttttctggcaattccgccaagttgagcatcaaattcgtttgagatgccgagagagataagatttaacatggagtcttcttttctcttagaaaacacgcatagtatcggcgttgaagaccttaccagtcgttgttactctttcctctagcttcatgtgcagagccgctactcgatcaagtaattctccctgatccagtatggtaatatcctgcaacacatcagtttctagcagattcaggaatagatcctgtgtgtattccgactctaggacatgaatcgcatgcgatatgtcaacgtctggaatctgagtgtttgctaaaacagttagtgcttgagacaaccttgcgtttctgttagactctagcatcagagcatctaacgaaggcattccgttatgtctttttgtaataattctggacagcttggtagatcgcggtaaatgcgtcattgaagtgatctttgcgcagtctagagaatgtctctagggccacctgcttttgatcggaggctaggagcattttcaaaactactgcttggacgttatacataagatactctctacgccgcgttagcgtctacttaaacgaaaaggggagaggaacaaaattcctctcccctcaggtcaaatcaattacttggcggatttagcgtcaagtttagcgcgcttagcaacaccatcgtgatccttagcggagataccacggcggctcagcatagacttaacaccacgctcggatttaccagttgcttctgcgatctcagcaacggtcatatcagcgatattcagaccttccagaacgtcttcacgtgccttagcattagagacttcctgaaccggcatagcttcgatacggccttcacgcagcaggctcagagctttaccacggatctgcttaacggtacgttcgaactgagcagcgattgcttcaacggacgcgccactggcaacggcgttaatgaaagcagcttcctgatccgggctaaagctacgtacagcagcggccttttcagtcggcttaacagcagcagtcagttccaggctcaggattttaccctgtacttgtttagcggtataagcaccaccaactacagcagcagcgatttcagcgtaggtatactgacccggatggtcgttcaggaatgcaaccagttcatcttcctgacccggagtccacggagatttggttacgtcggatgctttctgcacttcgaagccttctttacgcagtttagagccaaccgaacgagcggtaacttctttaccagtttcagcagccagttcagcagcgatgttagcaacagcttcctgagagataacggtcgcgttcagagcgttagctttagcggtcagggatgcagtgatttcttcgttccaggttaatttagccatttttatttattctccagtagaattttaatcgtcaagacttcgatgcccagcgattgtgcttttttgttatgaagaagaaccgatcttggtttcatcttcgcagattaagtagtttacagccttagtaacggaggttttcaccgtatatccaagactttccagatatttggtagcatccgcacgatttttgtaagtcgttgagcttaccagtaatacaaagaacaactccgttggattcagtcgccggggtaacttgagtttcccgcgccccactgaatttccatggtagattaattacgtcctgtcctgccggtgtattcttccacgaagctaagttttctccagctttaccttccgctttcacagattggaaatcgttgtaaagctgggataatttcttagcagcaacttcaccgataagagggatactaagagatccaagaaccgaaccaaagtcaacatcttgtctcagcttagtttccaactctagctcaagtttcgtggcgactctatcacctacagctctgactaaatcttctttagtcaggaaaaagagttctgaaactttcgtgatttccagtttagcaatcgtctgtgggccaaagccctttaacttcatctttgagcagaagttctcgattaatttactgctttgagctggacacatagacttgttacggcagaacaactgatcgttaactaagtccagtttcgaaccacaagaggggcaattcagtggaatttcaattttcattgattttcttcctcatcaatttatataaatattatagcaagaaaatcaggactaagcaatcgaaatttttctagaatttagctcagtctctcaccaaatatttctttccctcaactgaatgataatagtatacaccctggcgatgaaaatgtcaataactaactttaaaaaatcatcacggtgtatctattgaatcaagtgttactcgtaaacgcgttctacgatgcgagggataaccccaccactacgaattacacgaatctggcaaccgatttctaggtcaagggcagtgatatagccaacgttattcagggtagcttttgagatgacagcgtcgtcgatgactaccggagtgaagtatccaacaggagtaaccttaccggaagccccaacttgccattctacccgttctagcgtagtaacctcgccttcatcgtcttctttgatggcgtacgcaccacgagggaacttgttagtccaacctgctgcgttaaactgattgtttccgtccatacgaaccacaacgccgtccgttgggaaccaatctactcgactggagatatccagacaggtaacaaaaccatcaccctggaggatatgcatatcaccacagaaagtagcggtcaagccaactttgccggtctcacactgaatactatatgccgtgaacatcagtccaccttctgcaatacgggagagaaactctccagaatctttcaggttaatagcaccagaagcaaagttacgcatgttctcaacttctttggtgatgtgtacttcaccagtaatctgcaccggggtcttttgagagatctgtttaggtatgttcagtaacttcacgttatgagttacatcgttccctaggataccgttaccacgagttaacgcagaaa

SEQ ID NO: 645 - DNA, 2321 bp, Klebsiella bacteriophage F92/15
aaggtggtaatacctacccaggtgtctcctataagatgggtgaacacggaacggaagttgcaactcctatggtgcctaccaaggtaactccagcggataaagtggcttctgaacttcttctggtggtgctagaagaccggttaatctgaacatccaggcaatggacgctaagagctttatggagtacgcattggaaaaccctgcggcattccaggcagctgtagagttagccttgaatgaacaagggctgagcttaaagaacctgaattaactaaactaaagggaggacgtaattgtcctcccttctttttggaatttataaaattatcttagtaaaatttttcttgatatgactataatattaacattgagaggagaaaacaaaacatgagattaccagatccctttacacatcctcagtataacggccttgggtttgataaagctacactgatcgataatgatcctatgattagagatgagctaccaaacggcaaggttaacgaagttaaaacagccactcagtactggggtcttaacattagttatcctgtgatgtttcccgatgagtatgctgtactttcgtcagcaattctagagtataagcgtaccagaggctatctcgacgttatactcccacactatgagtcttaccgagtgagaggggatgcgaacaactgtcgcattgccgctggacaaaaaggctccacactggttattaccaatacgagctccctatctggagagcctaagcctggtgatttattccagttaaccacacatccaaaggtgtataagattacatacttttaaaaacgtagcaggagtatggacacttaatctataccctgatctgttgctcactaccaacggctccgagagaccacgtttcaatgggatccttttccaaactaaattaatgaacggagattcattcagcgaagagatcacagttgatggtgtgtatgatggggttaacctagttctgagagaaagtctatgagacagatccttccttctgcgaaagcctaccttgccaacaatgacaagatacgattagcgtatcttgtctctatcgaactcccggggtccacgggtaataatgctgtttacgcttatatgacggactacatgagagatatcagctacggtggtatactcttccaatcagggaaaattaaaacaattagcagtcacaaacaaaaccgcacgttaaccgtcggtagtttgaacttcagtgttactggtacggatgccaatgaagtcattaagctcgtgcaaagtggtgtatcatttttagatcgctctatctctatatatcaggcgatcatcgacgacaatggggaaatccttccagtggacccagataccaacggcccattactcttctttaggggtaaaattgtgggtggtggtattaaagaaagtaatacagtatccggaattggtacctctgttataacttggaactgttctaacgaattctacgattttgagagggttgccgggcgcttcacagatgacgcctcccaccgagggctcgagattgtaaatggagaattactaccttctcacggtgccaaacgaccggaatatcaagaggactatggattcttccatgccaacaagagcgttaacttcctagctaaatatcaagtaaaagaagaacgatacaagctggaatactaaaaagaaattattcggtctctccaagagctacagccttaaaaagtattatgagactgtcactaaagaagtagacctggacttcaaccttgcagccaagtttattcctgtagtatacggtactcaaaaagttcctggtattccggttttcgcggatacagaaagaaacaatccaaacgttgtgtatgtggtttacgcgttctgtgagggtgagattgaagggttcctcgacttccagtttggagatgcccctatgatctgtactgatcaaactgacagtacctctcgtacatgcttcggaacaaaaaagaagtatcgggagatactatggcaagaatctccacaggacttccatcaacatctctctcagagcatggtcaagaatacaagtacaatgacggtaacggggatatacgaatctggacattccacggcaagccagaccagacggtagctacggtactaagagacattgctgctgctaacaatttcttcctacagggagagaacggtaatggaccagagtactgggattctagatacaagttattagatactgcttacgctgttatacggtttactattaccgagaacaggaccgatattcctgaagtgtccgcagagttaagcggccg

SEQ ID NO: 646 - DNA, 2298 bp, Klebsiella bacteriophage F92/15
acttatatactggatgatgaattcacgaacgttagcacccagtacccacgagtcccaatccccattctagacgaacgtcaaaacgactccatgccatcttggatgtgggcggttttgaagcgcaggttagtcggggcggacggaggggtgaaattgtacgtcaggttaaacagagacggccaggtatcgtacccagaaacgtccacagtaacaccgtctggcatagtaacaacaccggatacacggatgttatatctgccaaccggaacacccccaaagatgatctgctcagtgataggcccgcggtagtacttagtccaggtactagaaccctcaggtttcatttcgatggtaacgtattcagcttcaccagaaagctctacgacaaccataggggcaccaacacccacgtcaacagattctgcaaaagaagacaccttagtgatcttcggagcagttttcatcttaaagttaacggtgctagagaggttcatccccactttagcagccatcagctctgcgtcaaccattgagtcatagaaagcaccctgggcagagtaggtagcgccagcgattaaattgttaattgtggcaatgaaagtatcaacgccagtaaaatccctacgggtggttaccccacccgtagttagccagaaagttctaccgattacatcgtaatcggaaaagattgagtgctgaatactcgcaatcgtgtaaccggtcacgatattctgcaataccatttgagctggtgctatgtttgaaatcatttaaatatatgcccatgcaaccgacttctcgccctttggtccctccgcctgaattcttggctgaagtgctctgtaaatccccaaagtgttcgagttgttggccttgtagtcgagcttattgtagcccaacaggtagctgtagttatataaactggtgatcttcgcggatctaagcagtttattagtgttgtcccttatttcaagcgtgtagaaaatccctgaaatcagcccctcttcttgtagcttatcccatcctagctctaagtcaggtcctacccattccgcagggtcaggagcaaggttaagcacccggaagttttccaccatactaaggttcttagctgagttcaaatctacagaaattgttactggagagctacggcgaccgttaatatcaacagcacggatctcaaaaatagttagtccagcaggctcacccacaatgtcctgtgacattctaacattaggtgtaaaagcagtctgttgtacaatataaggatccacacgatctgacttacgtatcgagtagtagactacgctaggggttaagctaggaagccatgaaagctcaccgtttttaccaacatctccaaccattcctcccggagttggcgtgtatttaaattctctcggcggcaggacgttattggatatttcaggaacggcctcgctactgttatccacctgcgttgagttaataaatacatcctcaccatactcctgaagagttacgtttatcttaccatcccttgtgttctccacctcatctactaggaagaacttcttattccagccataacgatcgtaggtgaatactacaggatcgttaggttctataccaaggaatttgtagggtaaagagaaactcagagagcgagagtaacgagacttcttaagctctctatctgccaagcttctggcagtgtagtagttggttatgttagcaaaagaaagttgaagtttcttgtcaactccacgatcttcattcttaaacttagaattatagaacgttatagagttggttttccagttcagggtaggatcaatcagagatgcctgaactgagttgtacttattacggcctgtagtatctgaaagatccaggtctccataagtatctaggaaattaagttctagcggattttttgaatctttctctacggtgatgcggaagatacctgataggttattcaacgccccctggaaggattctaatagctcctgtacgttcttaaacacagagttggagttatccaagattgtgttcatttgcattatttgtctgttttcggctgtccagctatcccacccaacgtatctccagaaaggctgccaactagtttcgtaagaggtgtctataatgtttaataggtcggcctcttttctccagtcaccaatcaccattctgtctacaggaatatttgccccaaagacagtggaagttaggtagtcaaaggtctgccatacgccattttggctggttttatccattttaacagaaccgtctgcctggtacacttttacctta

SEQ ID NO: 647 - DNA, 1410 bp, Klebsiella bacteriophage F92/15
ccgatttaccgtcctctgttactgcgtaacgtctacagaacatctctacgagtctacgctcgttagttgtgagagttgagtatttacgttggtgcagctcataaagctcctctagcattccctccagcttagttaccatttcctccgggtacttggggaatggtttctctactgcattcagtactgcgttagacgaacttttacgtgatctttgtagtgcatttttaaatctgctcatttttcttttctcttatagtccattggactctttttatagccacgggattgtggctcttaactttattcactccacctagaatgtgagaacggctctctacctgtcaagcgttcaatcatcctccggtgctcccgctctctgtgttctttaaacacctgaagagcggcgaaactgtccactggcgtgtacggcacgccgttaactttgaggatatcctcgcctctgatcttgaatagcggattgtcctgctgggccttagcgtggcattcgctcaagtactctgcaaaaggtttgccatcttcccgagtacacagggtacgaagaagatagctacaattctccccaaccggagtccatacttcatatttctcgttcattgtgttatcctcttacataaagaaatcttcatcggattcagctatttctttataaaagccgtgatatgcggcaactgcctcgctaggtgctgccatgtcgaataagcgtgctctttgttttaattcagctttattttggcactgcctaatcatttcttcgacttcttgctgcaagcgtgcatctacccgaaccaccagctcaccttcgtgaatcgacccgactttataggttaacatcgtgagatagcctgggtgctgtcgagactttttgagaaccacgttagtatacgctgttaactcatggacgaatactgcacctgggaacgcataaggagttagcttcttacgagcttttactgccttaatatctattaaatgaaagaagtctttcggagtcttggatatgtcgtccggtacttctacttggaactgattccagaggatacgtactttgttttcagacatgccgtagacaatgtacgtttcgttagcttcttcaaaatcaactgtacagaataacatatcctagccctcttacttgttgtagaactctgtagcactatcccattttatgagactctcgacattggcttgatcccagatatttctggagttagtcaatgcagaaacatgcggctgaataagttcgaacttgccaacggtagcaccgctagtgagcagtaacgaggttaatgcttcgaacttaacggtatcgctaccagacagctcgcttactgctttaaccttgtcaattatagagatcatcttagcttcttcgcccacgaacgtaaagcg

SEQ ID NO: 648 - DNA, 966 bp, Klebsiella bacteriophage F92/15
caaaagaacaaagttaatgagttccaggagagactttcatgcgtaactggaaatatggactcctgctctcggctgcaatcatcgcatccgggtgtgcagaacggccagacccaagtagcacagtaacggggatagagccgcaacacctaccgtggccagcaagcctacagacttgcccgtttaattttgagttcataaacgaagaagggaaagtgtatgttcgcataccttaccaggattggattacaatgggcaagtgtaatgagcaggtctacacctatattgccaatctgactgcattaacgtgtacctatcgcgtgtcacttaatgaatatcgttgcaaaccgttcaataaggaaacaaaatgaaatacgttttaggattagttggtgatgccggcgcaggcaaagacacctttgctgacatggctaaggtttgggcctgggaagtcctcggtccagagtattctatcagtaaattcagttttgcggctccagtttacgaactcgcggctgtaatccttggagtcacgccagaaaagctggcagagcgcaggacaaaagagattaagcagtggttttgggtgactcaggaagccctcgagcgtactgctaacgtctggaagcgttttggaatcgacaagtatgccgatttctcttacgtttggcctcagtttgaagcgtcagcgctatatccgctgattgctaagactgccccagacttttatcagggtcacgagaccccgctgtacccattatacacgtcccctcgtaaaatgctagaatttgttggcacggagttaggacgcgctctggtggatgagaacttgtggttgaatattgtggtcgatcgtatcacagctaccaaagctgacattagcattatttctgatgttcgttttgataatgaagccgctctagttcggaacttccccggtgcgcagaactctagtattcttaaagttca

SEQ ID NO: 649 - DNA, 856 bp, Klebsiella bacteriophage F92/15
gaaactagacgaagacgtctagaactacgcatattaaagagagccgctgagtatgtcgatagtaattaataaattgacaatcagccattttatgtcgtatgctgagaacgtggtgatcgagtttgataatcaccgcgtaactcagttaatcggacgtaatgggctgggtaaatcaacaattggtacagctctagaggaacttctttataataagaactcacgcggtatcaagaaggacgacctgtttaactggcatactggctctaaggcctatacgctagaaggtcagttcacgaaagacggtgatgtgtacaacgttaagaaagttgtaaagtcaaccgccaaagtaaccctcactaaaaatggtgaagatatcagcggtcacacggcgacccaaacctacaagctgatagaagaggtacttgcctgtgattttacgacatttactaagctcgtatatcagtcagttggatccagtctcgacttcctcaagacaacggatgctcagcgcaaggctttcctcgttaacctgttcgatcaggaacagtataaggaagtttctgaacgtgttaaagcgggacgtaaagccgtctcggcaaaactgtccggattggaaggtagcctgcgaactgcccaatctatactttcctcaaaagcctcgcttggcacacctcaatcagagatcccagtccctgttttcgatgaagagccactagtcgaagaattaaccgaagcaaaagtcaaggtagcactggctcagaagcaaaaagccagtattgcaaaacgtagctctttggacatggccgtacaagctgccgaaaaaacttttagcaccattcgaaaatttaacctgcgc

SEQ ID NO: 650 - DNA, 818 bp, Klebsiella bacteriophage F92/15
gtattcttaaagttcaccgcccccaacaacatccacgctattcaatctactcatgcctctgctagaggtgttgcaccggagtttattgatgatgtggtcacaaataactttgacggactggaaaatttaccgtaaaaatgtaaacgcgttttgcgacgagaggattctctttatataaggtaacaatatgggacaaattaataacgtagagcagaaaagtggcaataagactactaattacttcgcctccctggtggcgactaaggcagagtataatatttatcactatcatctcgatgggccgatagtcgatgtagactactaccgcgacctatcagtcactctggcaactatgcaagagggagacactcttaatctttatattaatagtcccggcggatacgttgatacagcagttcagttgtgcaaccttatcatgaactgccagggaaccgttattgggcatctggttgggccatcagcatcagctgcctgctcaatcttcctagcctgccacggctggttggtacacccttacgttatgttgatgggtcatacctatcgtggtgcacactatggcaagggtaaaaacgagatccagcactatgcagatcagtttaactcattctttgaggatatgatgctagacctgtactacccgttcttctctctagaagagatcactgagatgatagaaggtggtaaggatatttggctgacctccaaagaaatcaacgaacgtgtagatcgtatggctgcgcaccgagagcaagaagctcgtaaagctgcgggtcaataaaactaagtaggccagggct

SEQ ID NO: 651 - DNA, 323 bp, Klebsiella bacteriophage F92/15
ctctacaaaatcgtagaattcgttagaacagttccaagttataacagaggtaccaattccggatactgtattactttctttaataccaccacccacaattttacccctaaagaagagtaatgggccgttggtatctgggtccactggaaggatttccccattgtcgtcgatgatcgcctgatatatagagatagagcgatactaaaaatgatacaccactttgcacgagcttacccccattttatattattcgtgtgcgcccgcgcatcgcgcgaataaaggaaaggatatgtcctccgtatcattctagaaaatttcagttg

SEQ ID NO: 652 - DNA, 148 bp, Klebsiella bacteriophage F92/15
ctcataggctgtattaatagcctcaaacgtcttgccagtagctcgtcccggattgactgatagaggccaacgaaggtcaagttctaggaacctgaacagttggttgcgatctatgtacatgctggctaccttaaaccaaacaatgacg

SEQ ID NO: 653 - DNA, 138 bp, Klebsiella bacteriophage F92/15
gttattgacgtctttattgttgccagaggtgagagacaatactttcttgtcgcctatccttcctgcataaaaccccaataaaaacctacaaaatctcacttgctaacaagtgacttttataatataatattattataa

SEQ ID NO: 654 - DNA, 12224 bp, Klebsiella bacteriophage F105/15
ctaccttatcaatacacttgatgtattggtcgatataaatacggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgatagcataaccttcaagctcagcaatttcagatgataataaagtctgacggtcttcttcccagtacccgtctttatcaatccaatgcagagaaatatttggtgattttggacgtttctcttttggacctgtatcataatcaggaagagcttttctttgggcttcgagttcagacacacggaatactacaacttcatcagtatccatgattttcttcagctcatcaatgacatgtaattcatcttcattgtctttgattacagtaatgtgtgcccagattggaactaatccagatttacacagagcacgaaccgtagcaatacgcttacccgctttatcatcaataagaacgaacgctttagttctatcaaccccgcaaatatcagaaatgtttacttggttatgacgatgccaagaactgcttgacactttacgacgagcaggttcatcgcatgaaacataaactgatacttcgttatctacataatatgaacgaattttatcaagattatacttcgcaactacttgtttaatatcgcggttcccaatggtaataccgcggctctgaagaatagagcgttccttagaactcagcttattgaactcacgcaggaattcacggtcagattcatacgcttcaaacgctttaatatctgaggtaattacctcttcttcaagagcattcacacgcttctggatgttggcaatagtttcttcatcaagagaaagctcttcacgagatggagtgatatccaattcacccagtgggaaatgaacataaaccttaccatagcgattaagcagccaatctgccttaacatctacaccgctgataggatatacgatttttcctataaactgcgtacagaccatagctttcatacgaactattaacgctaaaccaatcagttttatctactgggaaatattcaatttcacggcgaagagaatctacctttggaggtacagcaccaaatgtacgcaaaatatatgcgatttcataatgccaagtatcaatatcttctactttaaccggaactgtaatttcaagaccagtttcttcgtcttctttcatatcatcgacaaacatcggacgaatagtaggttcacctcggtttttctatgacagtataaccggtggctttaccattatgatatgatactacgttaaatgtactcgtgtagctcagtggagatttagaaccaagaccaagagcaccgatgaaatcattactgttattctttgtggattcaaagaacgttttatacatcgtcatcatgtcattatgattaagacctgggccataatcacgaattacaaagcgtgggtcaagacgagttggtgctttgatgtaaaatggacgattttcattaccattcagtttatgagcatcatcgcagttagtagaaagttcacgaacaaccgcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaaggagctcttcagcagtagcggtgttagttgtaaaaattttatcactgatttgtttaaagcggtctttgaattcctctgctgcttggatatcaaagaaacgttggatgatacgatactctcgatatatagcatcatcaaataattctttatttggaacataacttttctttagcattttactgctcctgacgatttaatcactttgaccatgtcagcaattttaatatcaggacgtaaaaagcgtatcgctttcatagcaaaaaggctgtgattaatagggacactctgattactttccaaacggtcagctatagaatttaataaccgtttgattaaaagttcttggtattcattggaggggtcgactgagtattttagtgcttcagtgcggagtattgaaatgatagttgacttcataataatttcctcagaaaagaggggccgaagcccctgggattaatgcactctgctaacgcggccatacacctcatgtttagtaaccatccgagttttcctacccacgatagtaacccaagtaccaggaagaggttcttttcggtcaaacatgtatccgtaatcgcctgagaccaaagtaatccaataacgttgcatagtaattccttctatagcagggcaatattacccgtactatttattcactcatccaggtcttacgtggagcagcatcattacccataattagttcaaacagttctttccagttttcaggaagagatactacatcataaaccgggtcttgaataacacgttcgtattcatcttcttcaagagagccaagacctttaatatagcgaagtttccaacctttgaaatcatctttatggtcttcatattcaccaagagaatagaaccaacgttgttctttacctttggtaagaataataaccggagttttcacaaagcggattctaccctgttcaaacagttcaggccaattactgaaaaacgctaaaagacttgggaaaattgaaccaacaccatcaacgtctgcatcagtcatgatggcaatatttcggtagttagtattttcagcgggttcaccgatagtcaaaccagtgattgcacaaatgtcaaatacttctttattcttcatcgcatccgcagcagacattccccatgtattcatgaacttaccacgcaaaggatatccgccatgaagttcacggtcacgagttgtaagtagataaccgatcgcagaatcaccttcagttaagaataaagttgtgtcagcatctttaccatatttgtttgccttgatgtgcttagctactttggctttctgcgctttcttggcggctttagtttctgcagctttctctgcagcaagtttacgagctaacattgcctcgataataggcatatgaatatcttcggatttcataatagcgttagcaagtttcttgtaatcaatatcaatatggctacgaatttctccccaacggagaagtcagacgctctttagtctgagaatcaaatcgcatgttagacatgtcacgaataaacataatgacagtcagacactctttaattcgtgctttattgacttcaagtttgtatttgcgttttaatgctggaatgagttcattgctcagttcatcaagaactaggtcaacgtgagtaccaccatttttggtgtgaatgttattcacataagacagctgacggaacccatcatctgagcgaccaatagcaatagcacaagtatcagaatcctgcactactgcattttcatcatacatctgggcgtaagctttaaacttaccttgaacacgtttacccatgaatttaaattcaatatcaggataaactactgctaacgtcatcagacgatcgtggatgattgactggtcaacatcagtcagtcctgtactttcaaagtgactaaaatctggaatgaatgatactacagtaccagtcttatctttgatgaattctttgtcttttgctggatgttcttcccaggagatattttctgagccattagaacaacgaacaatgatttcatttttaccatcgcatgttgcaccagtgaaagatactgaaaagatattagttaacgcagaaccgacaccgttcataccaccggttttacgctcagcatcatcaccaaagttaccaccggcacgaggacgagtccatgcagctactggtcctggaatagtttctccttcaggtgttactacaggagcctgcggaagaccacgaccattatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaaccaaaaagaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaactgctttatactcggggtatcggggccgttgtcgttcaaacatagtccattgagcatcactaacgttagcatatgcatatcgagaatttccgtagtactgttcaatccggtactcgttattttcattaagtgaaatccactcttcacagacttcataatatttctgcatccaaatagtacgaccattcacgtcattgattggccaccaagcaaacctgtattttccaatagcccgctctactatttttaaatgtcgtttagcacgcctttgcgcagttgtcattccaataatcataatattctcctctggccaacaagactataataccaaaacatgatgtccatgtaaacaactaaatgacccgaaggtcatttattcataacgaattgtgctatttttgagaaaaagccctgagcatactgttccgttaacaggttttcctgtaggtccaatagcagtaaaccctgtatgctgaaaatcatcctctgagcaagaaaagaacttatacccggtaatttggatatcagtaaaccctgcattatctaatactcgagtagcgttatcagcgtcagtacatccaaccatcatgaaggcaagcgctgcaattagaatctttttcattttaattttaatttaaccctataagttatattacctactttaataacccggatttctccgggtttcatggtaatgcgtgctttagttcccatcaataatcaccgctctttaatccatcgtagtgaactgccggagcagaaactacacgcttcatttgtccttcacacttagggttaaagcagttaacagtatagtcacgatgggaaattttacgcataatttctatcttttttccacagacttcacacttgtaatcatacattggcattaacagcatccttcctatttttgtgttttgaccatgatttgctcattcagtgcacgagtaaccatcatggagatttcatcatctgatacatgggtatcatttttatggcgatttctgaaatgcagccaaagtgcatctactacacagttaataacatctgcgcactcgccttcaaactcttctttctgccgccatggacgattaatccaatcacacatttctccagtttctgaagaaagttgcagcatgacattcccaatgctacggttaggaataggataagacagttttgatgcttcaaaaataggagctaaatttaacattgatatgcactctgcagtgctgcaatagcagcgattgcttgaccacgattatgaatagaaatattcataaccaaatcggttggaattacattcgcagaagttccaacttcagtaaaatatttgaattcgctatcaaaaattacaaggtcttcaccgccaacttcatcacattctgtgccattagcccacataattccggatactctattattttggtggtcaactttagtaacagtaaaactcccgccattttcatagagttcatacacaaagtcttcattaacctcatagcgtgaagaaaattcttcttcagcttcatcattgacgaatttgtactgtacaccttctttaaaattcattacacaatctccatgtattctgggccatcaactgtgattacacgagcaaaggtacgaactgggacaatatcaccatggttcgcgaatacatacaaccaggtccagtgctcttctttaccgaaggttttctctttctgaacgacgattaagtcaggattgaacagaatgtcttcaaaagcttcggcagtaatttttacggtgttttcagttttcatgttattctcctcagtagttgataagataatagtaccacatccttgtggcaaagtaaacaacttttttatactaaaccttgacgttgtgattctgtcggctctacatcggctttaggcagaactgcatagttgccttgaaacactacgtttactagggttttaccgtcttcttcccactcatcagtgacaagaacatttttatgcggtgacagattagtggctgaattagtagaactcaccgattgggtaataacattgtccagtgaattcacgtgtacccacttgcgcagatagctttcattaaacatagaatccagtaaatcacgcgattcaagagcaactacgaatttttgcagtgaatatactgctttgtcttcattttccagttgaagcaaatatgaagacattttgttagaacggttaaagattccaacaattacgccttcctttccagcgtgttttccaccgataaccttaacgttttcgcctacaacctaaatttttcatcgtgtttctctcagtttgttaatgtagagccattatataacggctctttcataaagtaaatagttatcggtgagaaatttcacatccaacatcaacgccgaacagatacccagcttcccatcctttagccatcatagccttagctaccagaaccatcgtcggagagatttccgggaggatttcccggttgaaccactcttcaaagttttcgtcgaattcaaaatcttccattagccacgtcctttaggtaagctcagtggatcagtatcttcttctgaaggagcatcttcgagccccaaagcatagcgttgagcgtatttaagcattaaaatatctttagcacagtcatggatactatcatgcgcaatgaatccatcaagggtacctttaggcagaggagtagtcgttaatccacgagtcagaagcagcgattcaattgcagtacgaatatcacgctgattccagaacttacatggttcttctttaaatgtatcaatttcttcttcggaaattccttgggctcgttgaacatcgcgaagacaatcaacaaaaattggaaagtcaaagctctgcccacgacaccagccaaaggaatcccatgggtgaattccattatcaatcagatattgctgggcttctttaattccagcaattactgataaatcgtctggcgttgaggccaggttagcccgggcctcagctgattgtttcttccaccactcaagagtagacttaccaaacaaccgatgacctttctgggatttaaggtcaaacttgatacgatgaccacgtttaaccaattcatcgaagctttccagaacttcggggtcagaatcaaaggtgattagagcaagatcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacctcacacatagaatacatcataacgaccacgagtagtaccaacatataataactgttgcgcgagagaagcatctgccatgtgaatgcatggagtataaatgaaacttctgtcaattgagatgccctgggccttatggaaagtcgaagctggtaatgctttcactttatgaaacttacgcttagcatcccagaactcagaccaaggagctttacctcctttattccaattcttatatgtatctgcagtttttgccaagaagaattgaaacttgttcatttcttcttcagatgagatgacacagattttctctctagcgtactcttcatcatcgccataggtttcaatatctaatacccaatgacgaaccagatattcacctggaacacctctggcacctaaaaatgacgtggtttcaactgcatctaatatgcgaacaaactgaccattattgaaaagaatttcgctaaatttcttcccttcaaatttaagttccttggtaagaggttcttgcataacaacaatctcacctactacgaatggtcgttcagtttcatagattctgcgtctgattatttcattcaatttatccacagatttattcgtgaacgcaagcattctgttttcaaataaatcttctggggttttaactaaattaaaataatttagcataaaatctttaagggcagttcctttagtaaaaccacggacaccatgaccatcaactacacagtcacgaatccatccaccatttctgatttcagtagcgacttcaatgattggggcattactccgcatcacctcggtcaaatgaagttgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcagatgagaactcgaatagacgccatatccggaactttcttttgttcaaacagaacgttttcttcatatgtcgtcgggttaattttcagaagactatgaatagtactggcctgcattccactgagcttagataaaacctttttggccccatgcgtaggtgctgccaacgcaatgccagagataccctgagaaatcaaagcgtcaatgataaatttggttaaagttgttttacctgtaccggcaggtccattaatcgtaatatgttgacctttagctccttgtttgaccatttcaatgactttattaaaaatacgctttttgtacttcttttaattggtcaaacgtaatcatgccacttttaccctcactacatgtagatttttaatttttgctttgagtttttctacgctcaacatcgctaagtggttcatacactagctcagttgttttccaccaaagcattcctttggttttgcttttcccagtaaaattaccttttgctaatttgtctgttaaaaccgacattgtacgaatccgtgctttattagccgattcttcattagtgaagactacacatcgttctccatcatacatatcagttgtgactggatggtcaaatccgtctttatccttatacgctactacatatccatagtgttgcattacattttacctctcaaaagttggaagaaggaagcagtcaatggaagaccttttttcaattttaacttatctaacattgagcattcttctaaccgacgaagtgagctaacaattaaccgtattgattgtacacggatttcagcatctgacggacgattcggaactgacgctaaaatagcagataacttacgctcaactttagctaattcagacttaccaccgctgatacgagttctcaatgcattaataagttctaaatcagccgaggttgcagttccattcttttctttttgcacaaattgagaaagatgattttcacgattgcgtaagttagttttaattgatgtgatagttttttctatactcacgaatcttttccaaacgagaagcttctttatcacttgttggcttaacagaatctgaagaacgaactatgcgtgctgcgatttcattcgcttttcgttcaaggccttcaatcgtattatttccacgtaaggtattatacttttgcttgacaggaataacattccccattacgtatcccaaatcattattccaacgctcgagcgtcatgctgtcaggatggtttcctttgacggttccaaacttttcacctgagtatgcgcaatgtgtctgctgcatgatgttaaacagatattctggggtaagattgaactccttattccgacgctgggcagaacccaaagttgtaatcaggcgagtataaatcttagcggtttcagcagtgaatttcattatgttttcctacaaaaatgctttcgtcttacggacggtataatgggtctaagtccctagttctagataatcactagttgactaagctatagtaacactaaagtagtccataagtaaaccagatttttcaactttgttatgacctaccactttgaacttagttcccatcggtagcatcctttcttgttctttatcaatcatctcgatgtcagcgcttctgcgctgagcaatgttatcaatcatatcatttggccgcatgaattcagaatccggagcagtaattaaaagtgatttcatgttggtatgataatcaaatgattgatggcaattattgacttcaatgactacaaaggtcgagtaatgccatttgcctgcaaattctcgggcaatcgtttcatctgttgtgaatgacgccacctttccaaagtcaaatttctctcctttaataagggcgtcataaaaggctttagcctcacggcatgatagacctctatagagaatgtctctgttatcaatttgatggcgcctaacgatagagtcaagtttcttatgaaattcttcgccaatcttattgttcatgcactgccacagaattgactgttctttgcagtcaaaccgattggctaatgcttcccatgcgcttaaatcatataaaggtaatcctttgctttctcgcgcgaagttaagaacatcaatggaacgaatgggttcttcgataggaataacctttgataattttactgaaatagatgggtttaatgaaatagccatgatattctccattttggttactagaggtatcatatcatggctttttagaagagtaaactactttatgaaattattttgcccacggagaccagggcggcgggtcagaccagattgaagctagttcgtctagaagagcttctggggctttaataccatacttctgtataattatacggtattcgtctttgatgtccttagaaatcactggatgaacctgaacctcttcctgaggctcttccatcatttcaaacaaatccatcacatgaaccactccatccgacgatattgactgttactattattatatgcatcagcagctttttgaagcaaatcgctcggagtaaatctggcgaaatcagcttgcataaatgaccatactaactgagtaaatactataaaagcgtcttcattgtcaatgacgatacttttgccgttaacgattttatcatttgcatattcaaacagatcggtctcatgatatgcattggtatatcctttaaggtgtaaagcacctaaaatattaattggacttcctggcatgtgtgaaacatcaaaagtatgggctgttttgacaagtccatatttactattaggacaccacccgcgtgcttcaaatttattgaccagttctttaaactcgtcataagaataattgtaaattgctacagtgaatactttatcagaatcaaaaccttcttttagtttgcgctgtaaacttactttatagtatttttgcgtcggccacacatagctccttcagtcatgttgttgtcttcaaaccacttatcatttgctttaattaaagcaggcgcagcttttagtaataacgctgcagctcttacacctctgtaccaacaatcaaaatgagacttctttaatggtgattgataccagggcttagtataacatatcattttctctcctcagttagtagaaataatatactattcccagtatagcataaaaggactcccgaaggagtccttaattttatacttctgcatcagatggaacagcttcaaactattttcgcgttggtggttgcccaagttgcagcatcatcaactactgttgaataagcagctttttcagatgggaaaatctgatactgtgcgttagcaatgcgatgtgaatcggaatacaccttaaaagctacagatacttctgtaccttt

SEQ ID NO: 655 - DNA, 9833 bp, Klebsiella bacteriophage F105/15
ggctatgaacgctatcgtattgttcatccaaccggttcatacgaagaagtagctcctgatggtcgccgtaccagaaaaactgtagctgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaaccaaaactattgaaggcgatggtactatttttgtcaagggtaacattaagatagtcgttgaaggaaatgctgatatccaagtcaacggtgatgccactactaaagtagatggcaaccacgacgtgaccgtcggtggtaatttaacttggcaagtagcaggtactgtgaattggaatgttggtggggcttggactgagacaatggcttctatgagctcaatcgcccaaggtcaatacactgttgatggttcacgaattgatgtaggttaatcatggctgatatacttcctattaataccacgttacgcgaagtaatagaaggtgaatacgttgagcagtactttactgctcaattatctactaacgaaacattaaaatcaataaatattatcgactatcaaccagtatctgatatctctgtgtctgaaactcattataaaggtaattataactcggtttttacttttggaaacgatgtgcttaaataccgtgaaggcgatgagctgaagtccgcttcagcgtgggaggatttacctaatcccaaaactgctgatttatatctgtggaaagcccccagaacactagagaagacatttacctatacagttgagataatatatacagtgacagaagaatcgtctggaggttcatccggaggttctagtgctccaatcgtaacagaatataaaaagcaaaaggtttactctcaaaccgttaaaggtaactggagcagatggggcgaccaacttcgtgcttatgtatatgcggggaactaaatggctggactatcatttaataaatgcttaactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaattggcttagcggtacaaaaagagtttcaggactttgattttgctggttcgcgtttaaacgtgctattagacttattagcatataacacgctttacatacagcaatttagtaatactgctttatacgaaagctttattggaacagctaacttgagaagttccgttgttcaagcagctcagcaaaacgggtatttgccaagttccaaatcagcggctactgcatctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaaactgtgggtggatggtgctgaatggactaactggacagaccggtcaatggttcatgcttcgtatatttcaacaatttattatatgcgtgaaaccgtcgatggaaatacagaattcttctttggtgagggtgtggcagaagcatctgtggcaggaggagttcttgaaagcaacttcattggtggattaaaacccactaaaggcgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagattacttgttcattcgtcataatattaaagcttcttatgcattgaataagttgcaagaatcagagcagtggttgcagtcaaaaattatagactcaattaatagatattatgttgatgaagttgaaatgtttaacaaaaatttcagtaaatctaaattgctgacttacattgatgacactgaccactcaatcatcggttcttctgtagatatacaaatggttcgtgaaattgtcaactattttactcttcctagcgcaggtattaaatactataatactattactccgcggacgttacgttctggtgatttgggtctttactgttaccctaactgctgaaccgtattcagttaatatcgttggaactgacccagataaaaatggcaaaggaaatatggttattggaccgtttaagccaggtgacattaaagagaatactcatattcagccatatactgaaaacgattttgatagaactaccgtcggcgaaagaactcgttggtacaaaatcggtgaagtagattattatggtgataacatttactggagccttggagctattggagccgatcctcttcagtttgaagaccaaagtattgagctttattctactcctacccaggatatcgtcttcgcccgcgatggaacacttatcgtatttgagaatgaccttcgtcctcaatacacaactattaaattggagcctattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgagcaaaatcgtattgaaccgcttacttattataaaatgcgtgttcaaactacgtcagcaggatttgaaccgtctgaatgggttgaaacagaagagttccaaacttttgaagaaaacgcatacacatttgagcatatgcaagaattcagtttagtgaaagaattcattaaacagaagttttcttaaacaacatgtcgtatgttaacttcaacacatctgccatgatggcatctttgatgactgagtcttttcagtttagtcctgaatattctcatttatcagctatcgaaaacttcgttgtaggtgaatctggatatcatgaaattcagggacctattgaagcagtgtgcgttgataaaaatagaactatgctgggagaaatagacggaattttgtatctgtttgaaagattccaacatatggttaaagtatcaaatgataaaggacagaattggcaatacgttcagttatttaatgaccgtgtcggaaatccggtttctagagtggtaatttatcaatctaaaactacttcttatgttttaggatatgataaaatcttttacggaaggaaatcatctgacgtacgttggtcatcgaatgaagttaagtttagcgataatgaagttacatttgctaaattgggagaccagttaaagcttggctttgaagtagagttattcggaacgtatgcatcattgcccgctgacgttaccaaatatgctgaagcgtttacatgtaatgatgactatttgtacgttgttgcaaaagacactgtccgtaaagttaaattaaaagatgctccaatagatactgaccctttaagtcctacatttggtgaaaaggtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgaacttgagacgaaatatccagaactaatttctaccgcagtaaaaaatgttagcccaattcaatatcactctgataagcattaccacatgatgagtttcagagcagatgaattttcaagatgggaaacatttgttcctggacctatgaggttttatgctgaaccgtggtttgtatggatggctcgtgaaggcaacagatgctggataagtacagctgaccatgcagttgtcatttataatgatattctttatcaaaaaagaagtagatacagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttgcgtgacccggatttacgtccgtatcttactaaaatgatgccggatagttacttgctacaagatagtaattttgaactacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagcacaaatatttctgacgatttagttggtcgtacgatttatactgcttccggtcgtagtaatgtgacttatatcgagagagaataccgggacggtcgtctgttgtggcgtattactattcataacttatcaggacggttcattgaaggccaggaaattaaatcagagcgtacggactttgagggtattatagttcaaggtgtccgcggaaaggatatgttgagtaataacattgactatataaaccgcagccgttcttactatgttatgaaaattaagtctcagcttcctacttctcggttccgtgatgatgtactgagatttgttcatccggtaggtttcggttcattggtataacattgctgacaatgtttatcaatagtggcttaaatatgaagcatgttgagactatcataaataaactcaagaactataaatgggatgcaggactgccatcagtttatcctgatagagttgctattatcgcttcagatgatacaatagaaagagacccaataactaatgagcctaggtattcttcacgtgctcaagctggtgaacctttcccgttacctgctaactataatcaagaaaataacaatagtgttatcgctggacaaaaccctggacaacgacgtaaaccgttaagtcctacgtttgaccaatcagcagtaacgtttgctaattatcgcgatttagttaaccagcgtcttaaagacgatgcaggtaatcctcgcgatcctagaaaatccgacacaggtaaaaattgatgagtaattcaacaagagcaagttcaacgcgtagcacgatttatcgtgctatcattacatctaagtttagaactgaaaagatgtacacattttataaatcaattggtccgggaacggaccaaaacacattgtatgtttcatttggaaaaagacactccgtggtcagataatgaatctgaacctggatttgcacctccataccccgctgataacggagatggggtagttgatatttggacaaatatgatgggtgcagtcaaaattgaatcatctatgcttgactgtgttgttccaagaagagactggggagatacaagatatcctaacccacgcacatttctaattggcgatatcgttgttgctaactctgcgccatataacagaactgatgctggatttggatggatggtatatagatgtattgatgttccaaaagatggaatgtgttcaattggtaatcttacaagcaaagacgaatgtattaagcttggaggtaaatggacaccatcagctatttcaggttcagctcctcgaggtcgtggtgatgcaaatggtaccgtcgatttgggtgatcggatatctttgggaatatctatatgaaattccagccgacgtatcaattaacagatgcacgaatgaatatatcgtagttccttggccagaagagattgaagaatctccagctcgttggggatttcaaaacaacttaacttggcaacaaaacgactttaacctaatctatcgtatgaagtgtaatacaattagatttaaagcataccttgatgcaatttattttccggagtttagtcttccaggaaatactgggtttagacagttgtcaattataactaatccgcttgaagttaagccaatgccaaattctcctaacgttaaggctgaaaaaggttggtatagcgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagatcggtaatgcttctaccggcgacattctgtatgatggcggtgtgaaaattaatgataacttcgacgccatttacaacgccttcgccgaccaacgattatttgcagctggcggcggagcattgaaccaaaaaattacatgcaacgagctattaccaaaagataaaatttggagatgctaactctgcagggacagttccaatggggtcatgcatagatgctgattgttcagaaggtgcagttcaaatacgtctttcaaaaggtaaagcgggagaagctgtattcgttgtaaatagtaatggctcagcatcaaaatctaaatccataaaaataacaacaaatggcgaaggtgtagctgatgcatttaaagacggatcgcgagaattgattatcaacacaccaagatgtagaattgagctatggtgtattgaagtcaaagctaacggtgctgcagtttgggattattcaatttcaagtatgtttggcagcacatattcgccgttagaagctacatataatttaacgagttctcctattaatattcgacttggatataatgatgattactctactgttaaattgctattaagcttcagcgcaaatccaggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtcgatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattggtttattgcgcccctggccgctgggaatatattgaaaataaaactgtagataagctaactaatggcaacttaagtactgtagcgaaaaaatcaattattgctactgcgggtcagactgactttcttaacatttttgatggcgtagaatataacgaagactctcttaatgtatatcgtcgtggtaatattttatattacggtgaaaccagcgttatggataaagccaatgctgattacggttctcctggaacggtagcgggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatccaagacaattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgcaggtcttcctttattttattgtgaaggcgcggaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatattgacgatatcatggcagaaaccgaccaagtgtatatgaatgctgagcaattagtaactactaaaaaatcgcattgaatacactaactatgatgaaccaaatcagaaaaatatgcgtcctgtcgctgatgatgttatgattaaagtcaataacattgcagcatttctttgacgtaatttatccgattggcactatctacgaaaacgcccataaccacgcaaaccctgctgactatagtgggatttggggtgtggaagctttattc

SEQ ID NO: 656 - DNA, 9210 bp, Klebsiella bacteriophage F105/15
ctcagtctggtagagcgctccatttgggatggagaggtcgaatgttcgagtcattctatggagaccaaattatcggtatgacacaatacaagatggtgtaagctgagtagcgggattgcagtctcgttcagatatgctatcgagtatgggtgatatattaaacacatggattctgcaaagtcaatgtgactcggttcgaggccgggcataccgtccaatcacttgccattgagaattatattatgaaatattacggcttcaaaacatcccatttcgggaaagcatatcgtacagaaaacattgatagacgtcgagcatattacgaatcactgcataaagcaggacgttctcgtgcacgacaagaaggccaaaaacaagcgaaggaaatagaatgaatatttttattggtgtatcaaatgacgtaaatgctattacggtgaagctgtctttggatggaccggttaatttagcattagggctttcatcttgtgctaaacgggatttaatgattaacgccgactttgcatatgcatttgatgaacgcaaaggtatgtgggtttggattaaatgccgatatgattcactgattaaatatgaatacttcagtgagcgtgatattcaagaagttattgcttatcattctggttgtaaagtaagtaaactacgtcaagttcttccatttaacaatgtgtcagacccaaaagaacttgttaacgattttaaacgaattcagcaggcaaaatatgatgaaagattctaaaggccgagaagtacaagttggtgatatcgttttctacggagaacgcacatacaataaaggtggtcgcggttctatgaagtgtggccgtattactgatattgcttcaggtttagttaaagtagataatgactatgttgcaatgcgaagcaaatcattcgttaaggtttctcctatgttcgctacgatgtgggataacggaaccatctttgatatttaatgctacaaagataaacagatataattaactcataccaaacaaacaaggaaaaagaatgaaacgtatcgcactgattgttgaccaagaagctatgttcgctgctaccggtaaatttcatccggtgagcaaatttgttgctcgtagcgagaaaattgttggtctggtagaaactgtcgcaggtgatgtaattgtttctattaaaacgtctgaaatttctccggtggttaaagtagcagttgaaaatgacttctgggaagtagctgattttatgtgtgagtaattctgcctagcaggtggataagcccgacaaggcgccctcttcggagggcttttataaaagtcgtaagatttctataaaggccctgtagctcaattggtagagcgttcccctcataagggattggttgcatgttcgagtctttgccagggtcaccaaattatcaactgaggaaattgaaatgcatattaaatttggacaagttattcctaaaggcttagcaatggcaattaccacttgggaaaatgatgccgaccgatattctacccaaatggtttatggtctagaacaagaagagattaaccaagttattcacgttcttgaatggttctcttctcgtggtcgccgcggtgaatgtcttggaaataatgattataaccatgaagcaattcttgaaaagcttcacactgaacagaaatatgtaactcctgaattttctaagaaattctttggtgttgatgttcctgcatacgactgttcagacgaagagtttgatgcttatttagatgaccattattcttgttcaaatgaagttatgtatgctattcaggcttggttgggtaatccaattgaatatgactatgatttcatgcgagtatttgagaaagtagaaatctttgacattaaagaagaaattcgtattcctgacgccccggttgcattccatattggaattacgtataaacaaaaagaaagtccattgaaagtggattggctgaaatacgtgaaggaaaagtaatggatattggttcaggtagttcatatccatcatgtgctttgagtaactttgctcctcataaatttgtctatgatggtgtagaatgtgcgtcaatggagggattcttacagtccctcaaattttcttcacctgaaatgcaagcacatgtatgcacattagttggtaagtctgccaagtttaaaggtaagaagaaacgttggtggccaacccaaacgctttactggaaaggtgttcctattcatcgagcttcagaagcatatcaaaatttactaacaggagcatatgatgcacttagtaaaaatgaaggattcagaaaagctttggctgctacccggaatgctacgctcactcacagtatgggcaaaaataaagtttctgaaacgattttgaccgagcgcgagttctgcaatcaactttatcgtttgagaaatgctataaataatcaataatataattatcttgttcagtgttgaaatcggtagacatggtgacggacaccttttgagctcgcatattgcatcatgtgctggcgatggtggtaaatcgccgacggaatcagtcgtgcaggttcgagtcctgcctgaacaatctcggggcatagctcagctggatagagcagcggacttctaatccgcaggtcgaaggttcgaatccttctgcctcgaccatttcgcatcgatggtggaactggtatacacatagcacttaaaatgctacgccgcaaggattgagggttcgaatccctctcggtgcaccaaattaagacccgggaatagttgcttaaacttagtgaggaattcaacggcagatacgtctgtgcaactacataaggttcgaatccttatttccgtcttattgccgatttagctcagttggtagagcgcttcacttgtaatgaagatgccgcgggttcgactcctgcaatcggcaccaaattcgaagggaaacttgcgtatgccctcgttgagtcgtcagatagaagagaatggttcgtccattgccgctagtcggttgttccctgtcgcaagcataacctcctgacgctatacttctttggatgagactgatgcctccgagtccaaaggaatgaatttcgcaggtcatctgccagtaggtgatgctgtcgattctcagagccctgtcttcggacggggtctttttagtatacgataataccacaattatagcccagacgacctctagaaggtatctgggcatttctatatccccagctgtataaatccattctactatctagaaagtccctccaggttccctaaaattatttgaaaatttattcacaaagttgtttacatcagtagtcaactaggttactatagttccatcaaaacaaaacagagtaaacggagaataaaatgtctaaattcaactttatccaaattgaacgtggttataatcaatacggtactcctgatcgttatcgcgcggtttggattaaaggcgaacatgagaatgcagtgttcagcgtagcagaaacccgtgaactgaaagatttgattaaacacgttcgcaaagattggcctgctgttgaagagtactacgttcgagtttaccatgaagaagctgctacggttcaaatggctatcaagtttgctaaaactgttcctgctttggttaaacgaattgaagcggtaattaactgctaataattttggggagttataatgaactccccacctactgaggaaatagtaatggatacagcaaatatagttccaaaaactcttgctgatatacgtcttgaagctaaaatagccatcgagcgtttaattaaagcaacagtagaagaaggcaaagaaactgttcttattctcgggttagagtcatacgttactgattacatcgagatatttgagcgcaaacaaaaacgaacaaggtctaatcattaaaccatatgtttatgattggattaatccgtacgaataaaaacaccactactattgaaaggaaataaaatgtctattctgaaaaaacttagttgaattcatccgttctaaatttggtacctttgttgcacagaatacctctattgaagaccagtatacgatggcagcaaaccgtattattgatgaaatcactaaactgcgtaccacacatgttaaatcagtaaatgaagaaaaacgtctgttgaaacttgccgaacgaaaaagaccaggctggtgcttccaaagaacgagaaattcgtcgtctgatggcagaaggtgctccggttgaaactctggctaagcttggtcttctgtatcgccgtaccgcaacggctctccgcgccaaagccgctgaatataaagaaatgcgtgctcaaattgagcaaactgtagttaagctcgacgaacaacgtctggaccttgcagttaaactggaatacatccgcgaaactcgtaatgcaaacgctctgggtattacctctgccgatgatgtgattgaaatcgctgaactcgctaaggttgatgtacaagatatcatgatgaaagttgaaaccttcaacggtagtcagcctggtatcgaaaccacctctgccgatgttcaggaatatctgaactctctgaaataatctaccggggccttcgggcccctatttggataataaaatgttatatgaatgtgctggagatattccaatggcaacacctcaaattaaagaattaattgcagcaggattcccaaaagaaatcactgatattcttgagaaatttgcttatcttgatactcgacctgagaattggaaaactcgctataacgggtataacactacagttttgcctcgagctatcgttcttaaagactattccaagctgaaaaacttaatttctagcatttcgtctatttccgatggagttaagcttgtagatatctttgcacttcggtacggaatttattcttttaacgattctccatcaaatctaacatcagcccgtgctaatgccgatggatattctacctctggttcaacaacgtacaccatagttattgagattattcataataaaaatagctatcgtcttggcattaacctagttaaatatgtgacatctcaggatgattatatcaattacttaaattactgcattaatgaattgccaccaaaggttatgagtatgtttgactctaacaacatggtaggcaaacaattaatcattgatgaatttatcaaatactgccgtgagagggtgcagaaatgagtaacttatatctgccaagtgaacctcccgtttataattatgtctataaatttgaccaaactgactatgttctaattccagggatggtctgtgctgctggaactatgataacgcttatcataatcgacgtaatgaatttggctgaaattagcagtacatcattagtgaatgtactattacttacgtggggattaataggtttacttggtctaggattaattgagctatttcgttgggtaaagtatgttaagcataactgtgaaagaaaggctgaatggaaagagcaatgcaaaaatttaacccttgaatggaatcgcaaaaagtcgcttgagtttgttaaagaggtgagaagaaaatgaatgaatgtaaacctgatggattttggaaccaagatggactggcgccagcttttggaatcgtgacatggattttatattgtgctttcgtaattattggaggacattatttgggttgaacgtctcagtaatttcagaagttgtctttttatttttaggtgttttcgcattcagcctcatgtggaagctgattatcgcgttgattaattgctgcactatttttagtttaccgaatgaaatacaagaagtggaaagaaaaggaagagtttaatgcctggattaggagctgccgcaaatgattaaaacttgctatcgtggaatgattaaagactatgaattcggatggttctttctattcatgcttatttggttttcgttttcagcatttgttggatttggaacattctggggattttacttcttttctccagtcttcggtgatacactgtattatctaggttggatgtcaggaattggaacctggtttgcaatgcttgccagatggttgcatttcgtgtctcaacgtcaacgcggggtttttgataaacctaaagtaaagaaagaaaaatctaaagatgactctcgcaatgaaactttatcctggattaaggagatgaaataatggctgttgcagtgcatgtaaaatttgaaaatggtgatactcgccttctgtgttacagcgataatgaatcactgagcggtatcgagatttcacttaaagaagaactgcttggtattaatggacctatctgtgatttctcggtagagggttcatataactgtgatggtgtattagagtctatggtctatactgccatggaagatattctcgaagaaagttggaacgaatgccaatgaaagagctaagtgcaggaattttattttttaccaatgacaaacggcttttcatgggtcgtatgacaaatacatatatccagggcagaggctctagatgggatattccaaaaggacatgttgagcctggtgaaacaccaaaagaggctgctattcgcgaatgcaaggaagagactggatttactgagtttgaccaggacctcttatatgaccttggacgacatgattatgccagcaataaggatatccatctgtttggatatatgctccctgtgagcccagaaatgttcagaaattgccgttgtacagcttaccataaagatgaaaatggaattaattttcctgaaatcgatgcatttgctttaattaaaccaagccaatggaaatatgtaatgggtccaagtttatacaaaatcatggcgcaaatgtatagcacatctcggtgaggttattatggaagaagctattgaattaggcattccacacatttataagcatgaactacgatttgttcgtgacggaagatggattagcatatttcatcctcgagataagttgtcacgtacactaatgaagtcacggtatgtcttcagtgatagcgagtatgcaaaatcgtcgtattacatggcagaaaagttatgtccaggatttaatgaaatcccagaggacgatagaagagattatgtgtggtggaaaggtaaatggacgccatacgagaagtgtagccttgagttattcatagccaagtgcagggccaaataaatactcctataattaataggaggtccttatggatatttttggcatgctgcgtattgatgaaggatacgatagcaaaatttataaagataccgaagggtattggactattggtattggccacttactgactaaagacccgtcaaaatactttggctatttctaacctggacaagctggtaggtcgttctactggtggccaaattactcaggctgaggcagaagtaatttttgtccaaagatgttgagaaggcaattaaaggtattgttgctaatgctacattaaacccggtatataatgtattagatgatgttcgtagagctgctctgattaacatggtattccaaatgggtgtgtctggtgtagccgggttcccagcttcaatgaagttattactcgctaaaaagtgggaagctgctgccaaggaacttgcaaattcacgttggtatcgtcagacaccaaatcgtgctcgtcgtgtaattgaaacaatgcggaccggaacttgggccgcttatcaaggaaaataaatgaaaacttataaagaatttttaaatgaatcccgtttagcaacagttggcgtaatgactgaatctgttggaagcaatcttctgaagtttaaaaaaggtcagaagatgactgccacgttagaagatggtacagaaattgaaatggacgttgttggatataactacgtagtagacggcaagttatacaataagagccatgccaagtttgattcatttgatgatttcacctcttctattgaagatgagtcttctcgcaaagcagtagcatctggcgatgcacgctccttaatggcacttggtcatgagcgtattaagtctaagcagaacaaacctggcgaagataactttgcattagtaggttatcagtctggtaaaacttctaatggttaccaacgtactgttaccatgtacatgcgtaatggcaagattgcgttcgtaaacgatcgcggcgctattcgttacgctaaatcaattaagtagtttacattgagacggtaatgtggtatagtagccttattaaatggaggctactatgacacgtattaacttaaaggatataaaatgaaaacctataaagaatttatcactgaagcttctgtaggaaaggtccaaggcattaataaagatgagtggacctaccgaggaaatggctttgaccctaaaacagctcctattgagcggtatttagctacaaaggcttcagactttaaagccttcgcctgggaaggacttcgctggcgtaacgacctaaatattgaagctgatgggcttaaatttggccatattcaagatgttgttgctagtaacttggacccagattttgttaaagctgatggagaccttcggcgctggaatttaaaactattctctaagcagaaaggcccggtgtttgtgcctaaagctggtaaatgggttattgataataaattggctaaggctgtcaacttcgctggtcgtgaatttgccaagcataaggcagcctggaaaaatcttgacgccatggccttccgtaaagaattcgccgagattatgactaaaggcggatttaaggcagatttagatacctctaaaggtacgtttaaagacgctaatgttcagtacgcttacgccgttgctaatgcagcccgtaattaaaactaattcctaataaagctgaacacgacctctcctcatgaacgtcgagtcctctgagtgaagtagctttccctacctgtaataaggtcgagcgcaagtgcggtaaggggtttacatagtgtgtcgatggattaaacatgtgccaaggaatggccccatttaatttaaaacttttacctttctggatttaaaaatgaaaacttacaaagaatttatcaccgaagcaaaagcaccaaaagtattccaaatcggtgcgcaaggaaatttagacaaagaatacgttgacgccatcgtaaaaaagcattgttgcccaaggcgtgcaagtagatgcagttgaatttactaaaggcagcacctttaatattgttgtatccaaaggttcttt

SEQ ID NO: 657 - DNA, 8795 bp, Klebsiella bacteriophage F105/15
accattcggtgattcttctggaactgatattagagtaaaagccaacgggtcaagtgagccactacttgaatggtcttatggcccaggtattcgttcaaattcatctggcgcttttgttatctacgcaaaaacaggtcaggcactccatttaagaccgaacggtgacagctcgaaccaagctacagttatcgatcagaacggtaaaatgacagtcggcggtgagttcgaggcgcagaactcgaaaatcacaggtaacttgaacgtttctgaagataacagaatgattgttcttggcagaaataccgatattggtttagtcaagaaaagtaatatgccaggaaaaatggctatcagtaaatctaactcgtttactgttatggtgtcaaccaataccaacaatcagattaatcctgctgatacgtttaacgatatattcaaagttgacgctgatggaaaccaaactgtttatggaaattcatcagtttctagagctttgactgtatcaagtacagctactgttaacggtattattaatgccaacggcggtatcattgttcctactaccaagtatgtgcaaattgccgatgctcctacgcagaataaccaagcaacaaataaacagtatgttgatgataaggttgcttctgctattagtaatgctggcgacacgtatcttccattagcgggtggtactgtaaccggaagattaataattacaggtgatcagttaaaaaccacatcgctttgggctaccggagatactgctgttaatggtgctttaactgttggcggtaatgttgttagtaattacggtattggtagctttgttggtgctgtcgatgttaaggcccctcgcccgcagataatggtacaacgcacctttggttccgacattccaacggtggtgagcgtggtgtgatttatatgccgcgtgacaataataccatgatgggtttaagagccggtggaagtgaatggcaattacatggctctgtaggccaaatgataggaccaggagcacgttggagaattcattctgatggtaacctgcaaggcgatatttatggtgggtatatcaccaactatatcaatgataggtttaatcagtgtgctcaatgggttcgtactggcgctcagcaagactttggtccaattggtcgtccagcacctggtaaaactgttcctggtggttgggtgcttgttggtcttaacggtaacagcaacgaagctaaccagaacatgcaacttatcggcggacggttacaagtatggaaaccgggcgttcaatgggttgattctgcgacttgataataggggcttcggcccctttaaacttaaaggtaaaactaatgattattaaacaaatgaaaggtattcaatggcatcacaattttgagggcggcgcttattatcgagactgcaacgacaagtgctggtattcttttagaaattctctcgataaaaattacccatatcattatagttaatgctaaaacaaataagataattaattactataatggcgaagacccaaccatgatcgggttatttgctgataaagaaatgattttggatgtttatcaacttgacgattttcctgtggattcatgggatgaattctcacaaagggaatttgaatttgttgatgaacgcgttgttatgactaaggatgtacaagttcctaaagaaagaactaaagatgacattatgaaagatttgatgaagcttaaagctgaattggaatcattgcaataaatagctctgtaaggagagcaatatggcaagcaaacaatcaataccatttttgatgtgtttcttgggttgctcgagctattattcaaagatggagccacgggaagagttctcttttcccgtgttttgttgtcgtacttttagcattgtggcgtttgctggttataagtcagatagtcttattaccgcgtatgtcgatagtacttatgataagtatgacaagttggttcaaaaggatagagattcccgatttgataatacagcactcgaacaactccagatagtacatatctcaagcggtgcagatttttctgcggtctttacgttcagacctaaaaacttgaactacttcgtagacttaattgcttatgaggggactttacctagcacggtagattctaaaaacttgggaggatatccaatcgacaaaacaactgctgaatatagcacgcatttatcgggtagatatttttggacggataaggaatttgttttcttaccaacaaaaagaaaaccgcctgaaatatcgtatatgtttagctgtccgtatttcaatttagacaatgtttatgctggaactgttgaaatgtactggtacaattccaaacctgcattatctaacgaaagactaacatcgatatgtggtcaggcggtaagagctctaggaagagctaagtgattacttattactatgcatagccattgttcgatagatagactcaaatccctcgttgtattcttcaacgagaattctcttctcttcgtcagttaactcagaaaccattttacgaaagttgctctgatttaactgacgcccctgctcgttcttgattccaatttcgttcaagaacgcaataaattcatctcgcttctccatgatatgttcagcattgaacttagtcagaatagaagcaacggtaacaatttcttggacaatttcaaacttagtcatttatttttcctacaacataatggattatgtgattatagtatcatcttgataccgcattgtaaaccagtttatgccagttcccaacgagaattcaaatcttccttggtagtgatatactcagcaccagaggacatccagagcccgtagcgaccatcttttactttagccgttaaataccattcctttccaattggacgaaccctacgattcatccagtgacatacatcaattgcctcctgaaaagacaagtcaatcagactcccaagcgcgattttattcattaacgcttcgagatatctttgtgattcaacgacagattctaagttatgactcatgctaaaaccacctctccgcgattacctaaaatgctttcgatatactcaactccacttataatgtcacctctatcctttgctttaatagtaataattccatatgtataaaagtcggctgacaaactgaatggcttagaagtgtcctggttaaacgtagacattactgcttgctctaaatgttttacttctaagtcattagcccaagagttaagaactttaagcctaacttgtaaagtatattctactttaattgctgaaagcaattcaacgcgtttatgatatgccctggcttcatcttctctgcgtaaagtttcagtattcatagataatctccaatgtcataagcatcaacacatttctgaaattgttcaataacttcttcaggttcaacattagcgataatagctacagtaaaggtgccattattccaatcatgtaccatccagtccccatatccagcattctggaggtcttccattagttcagaatggatatctgctactaatccagaatggtcccctaatttcttatggagagcttctaggtcatcacaaataatagttaaagtagtacatttggaattattcagaatgcgcattgtctttacctttgtgtttttgcttacgttttgattctttggcagcgcgctttttatctttatgcacgcctcctttgttaaagtcattcttcgctactgggttgtacatgtgcaattacctcatttaagcagttgcgtgtaatatcaaaacgcttagcaataccgcattcttggatatgtgcttttaaatctccagcatgcacatatcccaattccaagataaaccgtttaatttgagccttttctgaacgatttaagctgttgaagtaatctgccttggcgcttattgttctcacgctttatcttccttgcattcaagttccttgatgtaatagtcaatatctttaatcatttcttctgtcattactttgtacatttcagcaagaaatggtttagcgccgccattaaatggatgactaaacggacagatgtattccttatccatgagggttttcatgaatttgctatctgccattttaaaccctgcttcatttgtatatgtaccccaattatcgtccatcatttctaacgaacgctggagcgatttacgttgaatttttaaaagcgtaatgttattctttaatgtactaatcattagtataaatcctctgagaataattcattggcgggtcctgatttaggacgaactgtattaacttgacctgcatgtgtagcgatgattaatgcttcttcacgtgtgaagtactcgccccactggtcaacaaatccttgattgtctccatggacatggtcagaaactaatttgtcacggaacatatctagaacgttcgccatatcaacagaataatgacgagtgcctggaactacaattgttccaccagttttcaattcaaaacgatttgctgcacaaacgatacgacgttgaagtaatcgtccatcccaccaatcagctactttaaagcagatttctggaatttcgctatttacattacacatttgaccaacttctcgttaaaggttttaataacttcacggccatggtctgcacctttcttacagtctgcaattgtccatgcttcaccattttggtatttgtgaagagcccgggtattaatatctttcacaagattcataatcaaatcattaatttcttgttcagtcatttaaagaatcctttaattttctgccacaaacttttcttttcacgaataccaatttgacgaataacaggttcaccctgcattttctctaaccactccattgagttaacagcttccgcaattggaacaaatttagcaagggccttttggtaattatctacatccatgatatgtttaccatctgcatcgtaacatgcgtagcatttgtgcatctttttatcaatatacccgatgaagtgtcctcggaaccatacatcccagcagtcagttggcatattcagattaaggtcaaccttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatgcggaaagtacctttgttgttaacttcaagactacgaataccgaaggtgcgtttttccagaactgcgatatagttactacggtaaacagtaagctctttcagaggcaagatatcttccatctcgctaagaatgctcatcatcaggtctttgtgctcattcatatcttcagtcagaggacgagctttacgagtattgcgtttcttcagaagttcaggcttgttctcttctgcatagataactgctgctttagagatgatgtcctgtgcttcaccagtgatgattaaaccgtcaccagatttctcgatgagacctttcttaatcagaacaccgatgtttgagtttacagaacctgcgttcatggtttcttcaaggatttcacgcagttcagcagaagtgatgaaattcttttttagctacctgaaccaggatagcagctagttttttcgtcagagcatcttcggaagctttgatgatgtaagttactttagacattgtgattctccatgattgttttattcaatttgtttggtatgagactataatatcatctgctaaccagcttgtaaacctattttattctgctctctgaaagtattttcttcaaagagcaagtaaaaatgttatacgttaaagatcaagaacttatcaccattctcaagtttaagcacccagaaatcatcatatacacaaagaacgacttgatactcttcaccgtcttcatagttactcgcttgaattacctggcgcataggatactcgcgattaacttcgaacacatcaagcaccacaatgttacctttgacatagtggctcagtcgagtgccatcagcttgagtggaaatataaagaatgtttttgatatcagattttaatgatgtaatcattttgttttactccgtgttgttttgatatggctataataccacagccgtgtaagcatgtaaacaactttgtgaaaataagtttggggcattctaaggagggattttggagggatatagatttatatggaaggacctggagatgacctccaggttccctagattaactgaggagcaataaaactagacctaatacggcaattacagaacctataattaaataaaattctatcataattcttccaggtctttcagatactcagcttcaggagttgtcttttcccagtacttaacttcttgcgccagacgttttgcttcctgagcaagtttcttcgcttcatcatcagtgatatgatagatgttcattgaaacgagtttttcagaatggtctttgaatagttcattctgttcaatttctttagtcagttgcttgcgagttttaccttggataacgatgttacctgcgataacctctttgataaattgagcttttgcctgggcaagattaaacgcctgtttagtttcagctattttatgctcgattcgtttggcagtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttaaccttaaagccaaacccggtcttagaacagtcatcatcatatgtgatgtatcctgcatcttccaacgggtcaagtactttttcaacgtaagaagctcgttcaaacttgtacggaatttcactgatatagattgagttccgtgaagtttctttatacacgccgtgcagctcaacagaaccgtcttctgtttgaacgtatttttccgttaaatttaggaaactgtacttcaggttccatcatttcgccacgaagtgctgctttagtgcattccaaaacagattcaaaactatgtggaagaatagaagttgaataacctgttgcaataccgcgaacgccattcagaagaacagtcggaattaccggaagataatacgcaggtggaacatgttctttgtctttatgcaccggagcgatttctgtatctttgtagattttacggaagttgtcagaaatccgacagaaaatataacgacttgctgcagcagattgaaccaagcgagaaccgaagttaccttgtccatctaatagaggatagttgttattccatgtgtttgccatcaatgcgccagcatcttgggcagacgtttcaccatgatgatatcctaaatcagctacaccaccggcgacagacgcaagcttatggaatttttctttattaccgcgagctaaatcaagagcccgagcaataacaaaccgttgtacaggtttaaatccatcaatcaagttcggaatagcacggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgtagtgaacgcaatacttccgattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagttcagagtaagtctgtgcgtcgcttgaatgctgacgagtaaacgccagtgcaagttgacctttgccataaccggtggtcagcggtttcattttattggcaggaatccagaacacaccatatgttacacagtttgaacgaagggtacgacccaactgagaccgcccagaacggatgtgagaaagaacactctcaaatcctgcttttgaacgttgtttagccacaaagaaacgagcagatgcaccgatataacctgctttgccatcattgagcatcaggaaataaaatccttcacgctcagtaatttcacgagatggagcacctgctgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacatgatgtgtcgtttcatttttgtaccttcccatacggtttctactaaagatttaaggccatcggtctgaataatatcaatcgcattaatggcaaaataaaattccgaatccaaatatagtgacaatccccacgtgctac

SEQ ID NO: 658 - DNA, 8533 bp, Klebsiella bacteriophage F105/15
ataataaaccgaatacatgagtagcattactcgttcggcttcttccatatatcgtttacgagccattttcagccttagtagttataactaatgttttaccatctaaagcatcgagaatatctttgatgcaattatctggcattggttgaacgctagctaattgcctagcaatatcatcaggaattcccatgcgaggaatatttaatttgctaaaatcaattttatccattagcagttaccgggaagtgttctgccaatttagcggcgatggcagcgttaatttgatcagcgaaattcttattcattgcgttaacaatgatttcttgaattcggcggttagcgctttcaatagacagcttaatacgaccttcagcttgcttaacagcatcatcaatagtttgacgaaccatatcatcaatagcatttttagcacatgattgggtagcgttacgcatcatgtgcgacatttcttctttagcagaaatatcactccaaccacgagtatggaacatctgctgaagctgtttcttaacttccgctcgaacatctggaatagttactgttgcaatattaacttcagattgtactgcttgttttagtttattctgggaatcttttaacaccatttctttaacgatgttattgattaccgactgttgcagttgagcacgggctgctgtaccttctgggaataattggcgtactgcataagtatctaatttaatgtcaatcattttaattttctctcaaatctgtgtttacacgtccggcatttcattttcagaatatcggttgtccaatcaacaagctgtacttgaatactaccgcatttttcacaaggcacaacttgtttagctgcagcttctcgacggtctaccatttcaagacaggcattccagtcaattttaaattcaggtacaggtggatactcaaactcaatttcaaggtcgttatcatcaacgaccatgtcttcttttaattggtttttcacagtaagctccgggcatactcgagagattcataccgctctttgtactcattaagcgatttgactaaatctgccatcatcaattcatgcttacttaattcagcttctttggtatcaataaaccgcttaaccgattccatttcggcagtaatactattcttagcagtttcaatatgatttactggtgttaacggaagaggcttaataacgttgagatacatatgtgctacatcttcatcaataactggggtggtgctcaatgttttaggaaaaatcttaaatgggtccaaatgtacttcaagaacagatgagttttcaccctgttgtttgcaacatgattttttaactacatccatatgctctaatgcagtacgaacttgcgctaaaagcgcccgagccggatactttccgctggacaaatggctattaatatgaattcgtacagttacattgtcaagttcttcggcacgaataaatgaaacacccttaggatttctagaactagtagaagatgcctggtatttcacgcggtcatcgcctttaagtaagcaaattgaacgattaagaatacggcgcaggtttgcattaaattcagaacagaagatttgagcagcgctgcggtcatgtctttcttcggttttaaacgctcctgccgacaaaattataacgctggccgtaaattttagcattgccgatagctaaactttttgagctgtttctctgctgacattgcacctaaccagcgggaacgacgaatgttttctacaacaaaactaacatagttggcttcatgtgctgccatgctatttagcacacgacgagctacattaccagcaattgctacgttataagcagctggatttaaatcatgtaaagctgccaaaacctttacgtgcttctcacgctttgacaacccctttccattatgtttatcaaattcaccggctacaaacatctttaattcattcttattcattatcttttcctctattttggactgggctcaaagagtatctcaaaatctccctgaacccattatacaacaattattcctcaagcattataactttgcttgggcgcttatagaaagcatgagttttatcatctttcgctaattcaaatgtagcggtaaactgtactttgcctctgtattcaaacggaatactttttggaagggagccgtaaaccgtagctccattctcaagtacaaccatcatcttacattgtacgccgtaatagtcttcataaacttttactgacgttacggtaccagagacagtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccattctttatatggaatgcgtacttcaagaggataaccatactcccgaagttctttgtactcttcttgagttaagcggattttccaccagccgtggtcaccggtatactcaggcttatccagtgaatccaattctgtaacatacggcaagtaactgcctgcgtgataagcttcaacttcacctaattcattctcccaaagataaccatcaaagggagcatgaggacgatcgtctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcatctctacgagatacttctactgctcctagagtaactgcttgcttgcgacgaacatcgcgcaaatcatagtgtggaactcgcttatcctggaaccaagaacgtttcattccgatagcttctgccatagcatgcaactcatcaaggttgtcgctaaacatatgacaattctttacttgatgacctctcattttccagccatgattcatcaagacatctacgtatactgtcatttctgattctcgatgtaggtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacgaagctatcttatcatggcttttctaagatgtaaacaacaaaagggcccgaaggcccttaaaaagatcggaaatcactgttaaaccatggcgactggtgctgtcgccgcttaagcaatttcagttggtatttcctattgtcttctataatcatcttagaggcttttagctcttcagccaatgagacctgtttacggtccatcaagatgaggttctgggtcttctgggcaaacgtctgaatacctttgagacattccacagattcctccatccctcgtttatacttggttcgggcagcatttaactgcccttcgtaatacgcatgtatagacactatagtactaaacacattttacctcaataacatctaagataatatcttcaacgtcttgctcagggaatgccacgccattggtctgcccatgctgaaatactgcttggtacgctgacggcgcagaaattcgggttgaacgttctttattgtcatagcatttaccatcaataaagcgtttaaatttaacttcataggtttttaacattattacaccttagcataattgacaatttgttcacggtcagcaggccaattcaaatcagagcgctttttgttttgaccaagcaatattttctcagcccagtgaagtttagccgatacgctcttttggacttctctgattgcttcttcaagataaatgcctaaatctctcgggttagttccttgagttttaaatgcattgagcaaaatatttcttacaacttctttaaattgattttcaacttccgggtgaataaattcacgatatccgtgcaacggatatccaaaagcatctaccatacgagtagtactaaattctttgttcataatccgagagcctcgcgttcatcaggatttaatttagccaaagcggcttcttttaattttttccaaccgtttacgcttagcttcaggtgtttcttcctgaacactaatagcagcgcttttaggaaaagtccaagattcgccattttcatcggtgaatgtaattagttccgttggcttacgattaactgtaccatctgacgccccacaagactgccccttaatgcttcttcggcaacgcaatatgaaccataataaccaaacaactcactacggcgatcgtctggtagaaacatacgctgcataggcttcactttctgtcattacccatttcattttaacacctcatagcgaataagttcaatacgatttttaagctcttggtatgatttacgccaaggcttataataagcatttaaatcttggtgttgtttatgcatttcgtctaaatgctttattgcatcctgcacgtttacaaggaaagtatcaaatactttgttagcgtattctttcctgagctcaatgaatggaggagcatgaaatacgtttaccattacacgtagttcatgataagaagaatggacttcagctaatacatttttcttatcgccaaagttaaacttataaagtttttctacagattgcttcacaggctttctctgctttacccttgggtttacccgcaaagatatgaccaggcggatatactttaatatcgtttaaccaacattcaatatctttaatagctgctaaactcattgtacccacgctccattttcatcaatgtaattaatccactcgttaatagtccaggaagaggtatcacctttaggagtatcagcgatatacattccgcttttaaagagaacacgttttacatcattagaaattaaagtagccattatattttcctcagttagggaggatttctcctcccattaaaattatttcagcattgttacttcagcaatttcacgccagtttttacggtcagtcgcgacgaaatcaccaatataaagagcagtacggagagatacgttacgcagacgatttacgttatctttcataaattccaaaacttcaataacttcggaatttcttaatccacggttctgtaacatagaagtagtcattattacatcttgaacacgaaccataatctcttcattagtgtgaacaccaaggtcaagataaaccgaacgtgataccagagcttgaagatgcggagcaagtttagaaccgcgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaataagcagaactgaatttgcttcacgtgattcccagagacggcagtataaaccaattcctgagattttgccgttcactgatttgtaatcaatagcgttagtatcatgagcatgttgtaatgctttatccaaagagtaagtcttaccgatacctgctgctccggagataatcagagaacgaatattcccgtggattaaaccgttagtcattaatcccatgacgttaaagcgtttcttgatacgctctttcatttcatcaacagattcaacaacttcaattttagcagctactccgtcaattgtgatatcatctttgaatacccaaacaccacgctttttgccattcagttcaacaaagactttaccatcaccctggcgagaatcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacgaacctttgaaccgagatagaagtcatcaacaaaatcaatcaagttgtcagtttcaccacggatgatagcaagcttagagaacgcttctcctaccatcattggttcaaattctacgccgtgagcttcagcagctttaaaagctttatcaatgttgtttacgacgtatttctaaagttttcattttattctccaatgtatctgtttgggtggtacaggtctatagtatcatcagctaacgagcttgtatactactttatgcatcttttgtaacaaaaagaaggagcccgaaggctcctcagttatgcgtgcttgttgatagcgttttctgcgatacgctttggaagtttacctgcccagcggaagaacatgataatcgctccaacaataaaagcagggaaccaaaagatgagatagaaccaatactctcctaccttctcaatagttccgtttttgattagatgtttgcagacagaccaacccacgataaagtaaattattgcaacaacgattggcactactatgctccaaagtaaaatcatatttcagcccagtaaagtgagaaccggagagtttctccggcccatgacataaaacgatgtacttgttttcgagtaggtctagcagagaacttagcattctctctacgaccagtctctctacaaactgcttccaagtaccaccgtctacctttatgaggtcttccgtaattcaagaagaccttcattgtatcatttgtagtaagaattgtggttttcaagataaaccttctcgacgaaatcgtcccagaacttcatgtctactttcttaggcagtccgttcttctcggcttgatgagccaggcgttcaactgcgtcaacggtcgtttccaaaatatcctgaacttctttgaacggtaattcacccgctttgattttcttgatcagaggagcatgcaccagaggatatttaaggtcaccggtggaatagatttcctgcaactgaagaccaccgcgaagggcatgacttagtgctttccaatctacgccttcgttagcttctgccttacgagcacgttcgccatattcagcatcaagcttctcaagtgaatacttcatttctttaactgtgatagttgtctggaatttacgacctaacacattatagaaatactgctgacctgatttatggtctgtaaaggtggtccactcaaggaattcacctaccggaagacgatcggcgatgtccttaactttcctaacgctcgttaatgcctttctgcttaggacgatcgtcatatttccattcaggaacatctcggataacatccaggactttatgcaaatcggctaaacgagaacccttaacgccatacttacccgcttgtttacggacatatccaagataagccttcatgtcagtggtatagaaacgagctcggttgtcttgaatgaatttccatacttcaggaaggtcagatgcaactaccaattctggtggagtatgcagcatatccaacgctacagtttcaccatcagcagcgagcttgaagaaatactttaagctgaacagctcatggtcaatatcgtctttggtatttttggtttgcgctgttgttagtattacgattggtgtggttcatcgcctgacacattagaatatcacgcggatgaggtacaaagatttctttaaaatccacatctgactcgggagttgaagtaccatacagatgtgaaccaaaataagattttacgattgttttcataagtagatatgattccctttagcgaatttaactaatgcattagaacgcttgacggcttcttctgctcgagctttatcagtagttctttttgatgtacggtaaacattacctaattttttgactagtgtaataatacactacttcatgtgtatggtactcttgtccatcaggatgctgctcacgacaggtttcttcacgcagtgtggtttcatacataggaactaatgcccaatcaattcctgtgctaatgattgccacctgaatgtcaagtctgttccagcgaaatgcattgatatatcctagtacccgtgattccgggtccatcattgcgaatttaatgttttcggctgaagctaatggcatttgtttcacaatgctcatacttaagttttttcttagtagttacgagttcaatttccatgacccgccctcataatatatgtctaaatcaatgttatctttgccgctgtacttgccagtcaaaggaataaatttaaccgtaatcttttcgccgtcatcaaaagtaaattcggcaatagggtatgtagaaattataccacgttcggttt

SEQ ID NO: 659 - DNA, 7175 bp, Klebsiella bacteriophage F105/15
gtcagtgcagcatcttctacttgttataaccacgcagaacaatttacctatcaacattagtgatagcaattgtgtcaatctgcataccacgagacactcgcatcagttgctgcaggtcttcacctttaaaatcaataattacgtttgccaccgggaatgggattggtttagtcggaaacacgattgtgctcgggtcagctgctggccagaagatagttgagcgagcatctttaattgccaggttaccatcttcctgcatgataatatctgcatcgtcaccaaccagagacagaatgctcaggaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacacaataatcattttctagacgttcgccaccgtgacgatcagtaacaattttggcaccagccttgattgattcattgtaatgcttacgcatcagttcaatccatttttctgcgacttcatcatcgatagatttatagaaagcaaagcgagcttcggaatctttaatcttatctttgatagcctgtttagtttcttcagttagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacaagatggcgttcatcagaaaataaattaactaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattggcatctaccatcttattaagaatagcagttattgccttaacaccttctgcgtcggtggccgaatcgtagacttcatcaaggaacagacagtttattttaacaccagtaaactttttcagcaatatcacgccacgtgaatagtaatgctatatcaattctggctttttcaccttgactaaacgaggcataactaaactcttctcgtccgcgagatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaatacctcgacgatatttttccataaccaaattagttttgacgagaataattttatctaattcttcttgtagcagttcaatcttgccagagttatcaatgaactcctgtgatgctttatcaattgctgctttaatacgacgtgctttatcaactgcagttaaagtcatctgcttcaaattactcatttgatttttgatgtctcttgcacgcgtacgaatagtattatactcgcgagctagttcatccagttcactctggcgcgtctttaactcgccaagaatggtattacattcttcaacatgatgattaatcttagtgattagagtgtcattagaatgcaaatcctgcaagcacgttgggcaatgaccgcctttatcatacaacccaagaacctttgagtatgattcaattttagaacgaatcttaaaggttttaccttgaacttcttgaattgactctgctgggtcatcaccaatcacgagttcaagcagttcgctttgaagagtttctaattctgctttatatcctcgtgcctctttcacttgctcatcatacatcgcctgcaggcgagctacattatcaccagaaagtttcttctgcttttctgcatactcatgatgagttttaatttcattagtcaacgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacataccgatgagactttcaaagtaggattgaaaatcctttgaacttgcggcttcatcaagcttattgccatctcgtaaaatctcaaagacattcggtttttgcccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgctgataggtcttcaagtgcttggatatattcttccattaaatccaataagcttttaactctacttcttcgccatcttcagactcaaccgagttgtcaactttagaaacagttcttaattcatgtactaccttttcaagttctgattcaaatttaggaaggtcttcatcgaccgcagtgataataattcgcactgcaagatttctgaactcttcaaaatcaacttgccctgtgacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcacttgatatggtgtggaagtgcccagaccatacttgtttgtactttttgaggaaatctggttccagcccatgagacttcattcctttaataaaaataaaagccattaagctcccagtgaccaatacagtattcagcagacgattctttgatatgcttcatgatttctgacgtgttctcttcacacatccatgggcacaagtcaatcaaagtcccatacaaaatccatagtcacaggcttttcaataacagtaatatgcttatacttaccaagaacttcggttgatgcattaggcgtcaacgtattcttgtagtgcatgtcatgatttccgacgatcgtaattaagttaattccttctttctcaagagactccgcaatttcacgagcgaattccattgtcttatgagtgatagctttacgaacgtacaaaaatatcaccgtattgaatgatagttttaattccatgtctttttggcataatcaatatgctgcttaattccgtgtcgttgtacatcctgtacccacgggtcatctgcgcggacacctaaatgccaatcgcctgagtgaataattttcatataacctctctagtagtagtttaattttatattattccatgaatagacaaaaagggcccgaaggcccattacttattttgtcattaactcaaattgttctttaaagcaatgctcagaatcttggtgttctaccaagaattcatatgctttatttcgctctttatcatagagcttccggtcagacgacagatgtttcattcgttcaaagacttcatttttattttcatcattcaaccacaaaatgccagaatcatgagaagtcaatggctttccatcaacccggaatttcaaagcatcaccagtagctttatggaacacaggaatagttccacaagcgcctagttctaaatgcgtgtattctaatgaacgctcaaggaatttatccggaagacgcgacagctgatagccaaatccagactgagacatacgctcaagcatttcagagttaacatatcggtcaagaacctgaggattcagacctggcccagttttaacctgatgataatgacggcaatagtcaatttcataacgttctttgatgttaataaacgcaggactacgttctaaaccttccaggatagtcgttttacctgcaggacgcagatgactttcatggaaatcaaacatcaagaaatagcctttccacgtagtagtacgaccaatccaacgatggatatcaaaatcaatagcagagaagtctttccaatacttatcacgaattgctttgatgttcatagcaggttggaagttataaaccggaggagccgcatcagaatcatcaaagaaactcaacccgccacttggaaaatattcttccattaacacggtattaaaatcgcgtttgagctatgactaaacagtacatcagcgcgttaacggtttcttcaagaccagcatttctacgaagtgacaatgctctatggtcatgttgatatacgactacccgaacctcaggtttaatgttctctatgagcttcttatagttatcaatcgctgcttctggagcgttgacagcaggtactgagttaatgataagaatgtcacatgcgttaagcagagataaggtcttatcgtagtcatctgccagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatattgacctttgttgttaattttggatattttaccattcccgtaataaagcaaaagggccgaagtcccttttaaattttcttgtatacaacataacccgccgcttcacatatacgcttagcttcttcaaagcgtctaagcatatctaccttggcattatgaattgcttcataatcgggagcaggtgcttctctcctagcagtatcacatttatagcagaaataactacgttttggtcctgtataacgttctgaacaattactgcaccggcatgtgtaatttccttccggccaatcacgtccaggattagaacccatcaaattcgtcatacatcccaattctcttcatttaccattcataccaccgtttaagttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagcttttaatcgctcaagttcacgtacggtttttacgaacaactttgttggctcgagcaatagcttgttcttctgccgcttccattagtttctgctgcagttcgtcgcgctcttcctgggtaatattgttcatgttattcctttggatggtaatttatttcaaatgtgaattcagtatcagtccaattataactatgttcaattatagcagaatctgatctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttgtcgtagatgtcctgaataaaggtttcatctgctaacgcaaccatatcatcgtcccgtgaatcatacacgttgtggacaaaatagctgtatttctttgccatttctttgcgttcttttttgtatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttccgcgatcagcataatagcaaggccgatcgtatcgttctgttttactactcgagggccgccagcagcttcagactcccggcacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcattatacgtgaaatttagcggaacatcaataacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgagtttcatttaacatagaggcatgcgtttcccaatacatgccctcttcattgtcaaaccaaac

SEQ ID NO: 660 - DNA, 6844 bp, Klebsiella bacteriophage F105/15
gttgccactcaatcagattgttaattcggtgaagcagaaccccctcctgaaccgacgtagacaactacttcaaattgaagcccatcccaaattctggtacggacgatatcacctacattaaacgttttcatgcgatgtaccaatgttcgttttgccaagactcacctttattaccaacgagtcatatcatatccgttttcatcacagatgactttgttcttcatcaagaagtattcatcgtcagtaaaatgcacatgttttactttacagcctttactcatagcttctagagcttcttgccaacttagccagttcatattttcctctcgagttaagcggtatgctgttatccgttgatagggctatggtatcactcatcaactggcttgtaaacaactttgtgaaatgaatttaaaataaaagagaggtcccataggaacctctaaatgaagggtatagaaatatacagaaggtggtcaagatgaccttagaaaggaaccggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttatagaactcatatgggaggtgtaacttatcgagcaagtcacgaactgctttgcatccagggcatctacaaacttcttcagggatgccatagatttctatcatagttcagccttaatctcagaaatcaatctttcaattaattcaagtttatcagctgtagtcataggataaattttgtcaacagtggcttcttcaagatagcaacggtcagcatcattaagtatacaccactgatcaaaatcatcagcatctatgctaacaccgttgaaggtcttaactcgttcaacagacccgtcctgtgtcagagctgttaaccaaaaatggcttaaatttaagcatgttgtagaattcaacatcctttgacgatgcgttatttagccatttatcaacagagtcttctttaaacttgtaccacttatcacaacaaaataattctatcatttcatgacctgttggagtttagcagtcagagtattaacacgcttctgaaattcttcattagactagtttttcatctttcttagtaggattaatccagtcagaaataatgatgagaacaataaatggaatagctacgaaagcacctgcggttaatgcaaccaaagcgataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccatttcttacccagagtctttgattatcagaaccacgccaatttttagtagttggcagtgatttctcgtatttcccatcaattataacatcgatgtgttgtagcaaatctaaatctttgatatcttcaaacttatatcctgtccacatccagatatctttctccggaaatcttgctttaacccatgctaccaaatcagatatctcttctcgattctggggataaagcgggtcaccacctgttagcgtaagcccttgaatataaggcttgcttaagtgagtagcaatctctttaacggtattcatagtgaatagctgaccgttacgagcattccaggtagatttattataacacccttcgcatttatgcaaacaccctgtgacaaaaagaacgaccctgcatccagggccattcacaaagtcagaagggtagattctgtcgaaattcattgaatcttacctcattacgtgcttctacttctgcatcatatttccacggctcatcagtctgaatagccccagccgataatccactttcagggtcacgggttatcgcaattcccaaagggtgcagaacctctttattgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatttcgtgggtagaaccacaggaaagacatttatctactggcatattaacaccaaaataatccaacttctcgatagcatagtcccataccgcttcaagaccttcaaggttacgcttcatatcaggcagttcaacataagaaatatgaccacctttagcaattgaatggtatggagcttcacggtcaatcttttcaaatggtgacaggttttcttctaccgatacatgaaaactgttggtgtaccatcctttgtcagttacgccttttacatcaccaaatttggcttggtcaatcttacagaaacgatagcacagactttcagccggagttgagtacagactaaaggcatagccggtttcttctgtccatttattgagtttagtattgatatacttcaggacgagtttaccgcttcctttaaaagtaagcatatcaaattcatgaatgccaatatatcctaatgaaattgaactacgtccatttttgaatagctcaagaatttcatcatcaggtttcatacgcacaccaaaagcgccttcctggtaaagaataggagcaactgatgcagtaacaccttcaagggatttaattctagttaaaagagcttctttacaaatatcaaggcgttcatccagtagtttgaacagtttattactgtcatctgaacttttataatttgcatccagagctatcctagggaggttcagtgttactacccctagattattacggccatcaagaacgggtttgccagaagagtctctccaagcaccaaggaaacttctacagcccattggagatacaggagtttctgaaccggtaattgctctattgtttcgagcactgatgatatcaggatacatgcgtttagctgcgcattctaatgcaagttgcttaatatcatagttcgggtcttctttgcgtagattaatgccttcttctacaaacatcacaagctttggaaagattggagtaattccatcgcgtcctaatccacgaatacgattatcaagaatagctcgttgaattaatttttcttcccatgacgttcccataccaaatgtgatagtcacaaatggagtttggccatttgaactgaacaaagtattcacttcatattcatatgcctggaaagcatcaaacacgttctttttctgtttttgaaatagcataatcttttactaatgctacttgatatttgcgagcatcacgtacatgtttagcgaatgtcttctctacataaggagccagaactaagtcgacattagcaaatgtagttccaccatattggtgagatgctacttgtgcagtgatttgcgccatgatagcagtagctactccaatactcttaggagtttcaatttgagcgttaccaagcttaaagccattctgcaacataccttttaaatctactaagcagcagttagtgaaaggcaaagctggactatagtccatatcatgaaaatggataacaccttctttatgtgcttccattacagagaaaggaatgacctgattggcgatatgtttagatacgataccggccatcaggtcacgttgggtaggaaaaacacgagaatctttgttagcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatattagtttttctttttcttctttatataacttaccggttaataacatactcttacctcagcgattagataagagtatttatagctaaattaacgagtaactactatatacattatgattagattctttgatgcagaatgaagtacagaaagcatatatgccttcataatcgtctacagtgaaatcaatgtatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatgatgaactccaagacgctgttcaagggcgacgatgtaatccgcggctttttgcattaaagcatactcttctgaatcacaattttcctgtccagcaaaggcataaagagctctggtaattggaacgattgcaccttggaaatggttaagtttaatttcagaaatcagaggaacatcttcaccttgaccaatttctttaatttggtgcatcgtatcttcgctgtagaaacaccagaaccaagattcgccgtgtggagttgggtcgttaatagtaatgattttgtttgtcagcaaatcaattacggcagtaattccacacatttcaaggtcatcttcattaactacagaaatgacttggaacttaaaccccggaataaacacaggaaattgctctgttaattcgtcatcattaataatgacttcaaactgcttaccaataagtcccattcactttgtcctcataatcaagtagttcgtttatggtaggttcagaagtattataatcttcttcaggaatagcatcttcctctggctcgacagtttcccagcgagccgcataccagggttttagacctttgctactttgcatggtgttggttcagcatcattagcagaatcatgttcaatacgccattcaacttcagtacgagtaaccactttttcatggcgagtaacgatatctacttcaggaggactatcataccaatcagtatgatatgaacccgaacgagattctgataccatgaaatgaacgccgcgtgctggataataccaaatctgcgaacggtcttgatacttgtgctcttgtgtccaatcgtcgtcttctaactaaaacaaagatttcttctgcatcgtcgtctggtgcattaggcggatattcgaaatcgtagttgtcgtcccaaccgccagtgacgccagcgatatgcttgatttcttttactaattcagcgttagtcattttaacctcgcagcttctgtaagtcttcatcatcaatccagctttctaaaccggatggaagcgaacattcaatttcccacagcaattcttcaattgcttgcaggcgttcaagctcttctgctgaaatagttaccatgcgtggagcttttaaatcgccaatatcataactcatagttcttcctcatgccaagaacagtcaacttcaaagtctggaccaaggtcttcatcttcccaacgcaaagaccataacggattaccagcatcatcgtaatcaatttcaagaccaatataactccactgaacaccatgaatggtatttccttgctttacaaagaattcaccccattggtgcatgaaagcatactgcggatcagatatagctctttcaatcattgcttcacgaagattacgttctaaatctacttggtcgccttcaggaaaaacaaactcaattgggtatttcataatttcaccatacactcgccgtatttccatttagacataaccttaactccattagagtaagttacctctaccttcgctcggtgattcttaatctgcttaatttcaccagtttccaatccaccgtaaccataataaagagctacaatatcaccctcccgaaggagggttccacgataatcatgcattgaacttgaatttacggagttcatcaaaaccaccgatatgtgtgccatcaggagcaaaaatactgaggcatagttaatccaacttgtgattcacgtcccaaacgacgaagcaaatcactgataactacttcatcaaatacgtcctttttctggcattacattgatgaatgcatactcttgtttcttaacatcgagcagacgctttgcattatcgcaaaatacacacttatggatgttgctgtcgtaaccaaaaaccgtgaacatcttcttctatttccttaaatacttgagcttgaactgttttccaactcgggtgtttatacgctttatagacgttagtcattccaagacgcttagtggcttcgccatcaattgcagcttgggcaaaatttcttccacgggtcatagctcctttgagattggaactgttagcaatttgaccagtctcattataataaaccgaa

SEQ ID NO: 661 - DNA, 4908 bp, Klebsiella bacteriophage F105/15
agccgacaggattaacgcgccgagactaccaccttgggcttcacgtaaccatagccccatttttaaatgtgatggccgggtctgtattactaacgccgttgacattcaatacaccaaatgccacagattgccattcaccaacaccgaggttattacgagcggcagctacagaagttgctccagtaccgcctaaattgattggttgaacacccgcaacaacctctttccacgcagaccatgtgccgttttggcagtatcgaacaaatgtgccttcccagcctccgttctttgtagtaaaggtctgcttacacgtccaatcactatcagaaattttacgcaaagacagaacttcaagaacaaagttgccatcagaggtaggtttattagctatattagaaccaccacctgatgagaagcatttatacatccgacgagtaccggggtcggttcctttaatgacaagaccattaaggtcaacagtcttatcagtaatatcaactgcctcttcagtgccgcgataggtctgattaaaaactaaatccccttctacctcaagaccgctggatttaactagaatatatttactaggagctggagtagcaactgcatcttgataaccaaattgcacgtgtccttcaggagtaactttaagcattgctacggtagcaccgctaccaactttacgtgcaagggtcaatctgctgtacttgtctgagttctctgaacctaaatcaaccatcgttccattaggattttctacctttaagttagcgttaatagtcaagttaccggtcatggtatcaccagtcttgcttacttgcttattatcgccagcagtgatatcgtctttaatagaagtcaaatagttgttaaggttaccaccaaacattgaacctgaggtgatgttcccgtctttggttagcattgctgctccaccaattttaactgctacaggaacatccaggcggccatcagaacggaagctaaaatcaccggcagaaacatcaccagtagtttttgcacgaatattaatctgacccaagtccgctgtattaggcgtcgcccagattacaccgcgttcgttagcatctgttctgaaccatacatgagcatttccggttccagcattaacatatactgatgcagttcccggcccagaagcgtggaagttaggagcagttaaatcgcctgtcatggtgtcgccagctttcttaacttgggtatcgtttgtcagattaccaagtccaacgtcagctttagatggtttaaatgcagtaccgtaaagttcgttgtagttaacatttcccgcagcaagagcactgttgttagctgcatatacacgaaccctagcactagcgtagtctatattaatagctgacatagtatcaccggcattcataaaaataccagagccatggctaaaaagaccattttgaacactaacaccagatttagtaacaccgcgccagaaagtaccaccgtatgcttttaaacgagtcaacatatctgcgttagagacaatatcgttgatggatttaccgccattgcctcctaagccataagcgccattttctaaaacgttgccagcagattcaccgacatcacgcacagcagcagtacctaaacctaagttgtttcgggcatctcctacattagtagcgcctgtgccaccccggttaaccggaagagtaccagtagtatcaccgaaatcaggttttgcgtaactatcaaaaatctgtttcattgaaaccagaatgcttccagtcggtccagtagcaccagtatcttgattggtttcatagatgattactgtacctgaatcttgcccgttatacccagacgtgtttagcactgtaacataaaggtcattgccataacgaggaagcttagcgtaaaaatcaaatgaagcctctgaatccgtagcagcatcatttttaactaacgtaatattctggaacgtttcctctggaaggagacccaacccggcgccattcaacccatttatctaaactgttggtgctccatgatgttaaatttcgtcctgataacgtgataaaatcaacgtaatgtctatcgtgcccagaatcaataccaccgctaatcattaaatccagttgcgaagaacccattcctggatgctttattgtagctacttttacccagcgagcagttgacgcagttgcagcagaaatagtatattgccaggcttgacgatgttttctacattcgtcagaagagtaccggatttaccaggacctcttccgttcatggcataataaacctggtaatttctgaacgacagattactatcattggttaattgaagaacacctgcgcctttttggttttttaatatagacatcattagctcctacgcccatttcaagaacactagtgcttccactgtaaattttaatggctttattggtggataatcttaaatccccaggaagagtggtattacccgagccgtcaagcaagaccaactttctagcttcaacgttaccggcaccacgctgtacaaactggattgtttcagtaccatcgtcaatagtaccgatttcaagaataccattattgcttgtaccaccggcaccaatgtaccaaccatcattagtagcgcatttgccaacgatatgacgagttatttcaccgctcaaatcagtagtttcaaaactaattgctttattcggagaaatagttacattgtcttttaatgtagtagttccatcaacgctaagagttccagatgtatctaagaaaggaacccctttaccagcaagctgaacaacattatcagcttcatctttggtatagatagcgagagtacgcccatgtgtattcaacgcgatttcgccacgggctacgatatctgcacctggtgctttattctctgtgctagttcttttaaattgtatttgttttaagttttgatcggccatggctacctcttagtatgtgccaaaatctattgttaccccgcgtgaaataacctgatctaatctaggagcatattcaccggatgttgctgtgtttactataactacgccagcttcagctcgtagtgcacctgtcatggtatcaccagctttcttgactgctgcgttagctacgttgctaacagtatttattcgtccatcgacataatctttacgcgttaaatgctgagcggctgtaggagcattattagaactaagaatagaagctgttatacttcctttgtttatttggtccccggttctagcgttccaaactactgtccgttctctaccctccagtgaagtacgaataccgacaccgtaccatgaaacaatgtcaatgttcgctgttgttagagatgctgagtctccattaccagaataaagcccgtttaaactgttgccgccactgaaggtcgcagaaacttttacgccttctttaaattcgacttccttttggaaaccttgagaacctgtgccaccattagctttagatacgaaatcattatcatttgcttggggtttatctatctcagtataaacctttacacctctataagttagggagtttcctgccggcacaagaggaaaagtacccgcgtgccaaataggatttccaccaactgttgaacctgcttttaaatcggccatagtttatcctcttatatattttctatttataacgaaaaaaaggaagcccgaaggcttccttaatcagatgtttctctgaacgattgaactggaataacaccgctcggatcgacttttgaatttggaagttccataatcatagtggttcctccttcaacgcctttattcattcttacgccattcacgccaaattcttgaacaacactgttaagtttttcgctgtgcgcggtttgaacaaatacaaggtttttgattttagagtcaccaactacagacgtttttggatatcgtgataccacgatagtaaatccatcagcgtccgtaggaacagcggtaaatctttcaaatcttaaccatctatcagctccattttttggaatttctaatgatacgtttgaagataataaagatgtgcccttgaaccaccgcaagctagctctagtagtagaaccagcatcaagaaggcttttagatgcatacatatcacatactaaaaacaccgaatccccaggagataatccataatcagctattttgcttatagattcattttgtaccgggtatcgtttatattcatatccagtagaatccgagtattcattggtatcttcaatagaacggtaagggcagcctgtatatcctacatcgccaacgttatcatataccgtatctactttagctctggaatcttctttgactacgccatcatttccgtaaaatgactcaattaatatacgtccttttgctgctccgagcactccaacataggcggagtttggaaatgatttagaaaagtcagaacctggccaagaagcagaccacttgtttttaaacctatctgtctattaatggactggattgaaatcgttcatgtgtcattataatatacaatcctgaagttaatccatttgcatattctacaaatgctttgttattagcgttgttatcatcagtggtaacgtcaaatgttttaaagttaataaaactgtcaccattaacttgaacaacattaatccccctccgtaaggaggaggtcatatcaaaggcaccattaatattcaattctggcttattaggaacagcattagaatgcgtagcataagcttttagccaatacttcacagagtttgtctcagagaggattcgtgtttccacgaaatcctcgccaaaggctgccattaaaattggttcagccattaatcacctacccattcaaatttgagtagtttggttggacggtctggccagtattttaactgggccaagcttaatccattcc

SEQ ID NO: 662 - DNA, 4760 bp, Klebsiella bacteriophage F105/15
taatccaagaagctatgaagactgttatccaagaaattgtgataaattaaatggtcaatcacacttggtttatgttcataaattaaatatttctccttcggggaagtaactattgagtttagtactccatctgaagctcataaggatgaactttatcctcatgtggaagcttgtgttaaacaacaaatccagagtgcattaaagaccagaaaaaatacattatggaaaatcttttaagaggttaaagtggtagaaacaatcttagctaatctgatttacaaccaggctttctttacgaaggtttggccatatatggacaaagagtacttcgagcaaggacctgctcagacggtgtttaacataattaagaagcacgttaatgaatatacagcaattccttcaaagactgcgttatgtgtagcactggataattcgtctataactgaaacggaacatgaaggtgcaaagaaacttattgataagttatctgatgctcctgaagatttgaactggttagttaaggaaacagagaagtacgttcaagaaaaggctatgtacaacgcaacgtctcgaattattgaaattcagactaatgcccagcttgagccaaataaacgcgataagcgtcttcctgatataggagctattcctgatatcatgcgcgaagcgttatcagtatcatttgatagctatattggtcatgattggatggaagattatgaagctcgttggttatcataccagaataaagctcgtaaagttccatttaaacttagcattcttaacaaaattactaaaggcggagccgagactggtacactgaacgtattgatggcaggcgtcaacgttggtaaatcgttaggattgtgttcattggctgcagactatcttcagatggggcataacgtcctttatatttccatggaaatggccgaagaagtttgtgctaaacgtattgatgctaatttgcttgatgtatcacttgatgatattgatgatggctgtgtatcatacgctgaatataaaggcaagatggaaaaatggcgtagttctagtactcttggccgtttaatcattaaacagtatccgacaggcggtgctaacgctaatacattccgagctcttctgaatgagttaaaactcaagaagaactttaaaccgactgttatcatcattgactatcttggtatttgtgcttcttgtcgtattcgtcaatatactgaaaacagttacacgttagttaaagccattgcagaagaacttcgtgcgttggctgtagaatctgaaactgttctttggaccgcggctcaggtcggtcgttcagcgtgggatgcttctgatatggacatgagtgatattgcagaatctgctggtctacctgctacggcagactttatgctggctgtgattgaaacccctgagcttgctcagatgaagcaacaattaattaagcagattaaatcacgttacggtgataagaacatcaacaataagttctctatgggtgtacataaggctaatcaacgctgggtagaaattgagcagcaaaacgacccaactaagcctaatccaagcaataccgtccgagaaggtgccggtgcacagaaccgtgtagccgaatctaatcgtcaggaacgagtatcacgttctaagcttgatgctctggcagaagagttaaaattctaggtaaattttatgatttttgtgtttagcgcggtccgtgaccaatcaggtcactcttttgtcgtaacagccacagataccattcaccgaggcatcgaggcatataacaaagcagacctatctgtatgcgactatggagaggtcaaggtgtataacagcgatggcatctgggttaactctgctacatacctacctaccaagaatctgacctctgacattttgttagaaaaaattgttacaaaagatagtttactttctccaaaggccatgatactatggccttactgaaacaaaacgagtagaggaaacaaaatgaaaaagattgtacttgctttagtgttcgcagtatcaagttgctctgcagttcctgccatggccaactatgacaaagacttatgcgagtggtcaatgactgctgatgagtctgaagtagctcagcagattcgtgcagatgttggtcatgttgtggaaaacgtagacccgagcaaacaatcagaagtgcaagcagaacttaaagacgacggtgcagcacttaagttgaattatgttctttactgtgatgcccagtttgataacttcaacatcgttaagtggattttaggatgattacatacgttttaataatggcgctatctacgggttcaggtggaatgtctactgaaaagatggcattcactggtaaagatgaagctgtactcaaacagacgtgcgaagatactgggaagcagtttatgcttttcaaagatagtcccagaacaatgtctccaactttgtatcctacgtataagtgcctacgtattgcaaatgaataaatagtaggaggctctatgaaaacatacaaagagtttgttactgagatggtcgcaggtgatgctggcggcaatccacaaaatattgcatcaggtaccacttccggggacatcgtcaataaaggacccgaaacccttccaaagaaacgaaaagcggataaagacgctgccaagaaaaagtgataaaatggccttattagtttaaggccagaggaaatattatgtcttgggttgataacgagtatgcaattcgtgcaatatctcacctacctaaatttagacacgttactacatcttcaacattcaagttaaactgccgttgcccaatttgtggtgactcacagaaagatatcaataaagcccgattctggatttttgatgcaggtcaaggattgcgctgtcattgcttcaactgtgagtataacaagtggctatcgcagtatcttaaagataatgaacctgacctctatcgagagtatcttcttgagaaaagaaaggagcaggtctttgataagccaaagactgtagaaccgtctgagaaaattaatgcaaaactccccgtaatagaaaaacttaatttctgcgagcgattagatagacttccgaaggaacatccgatagttaaatatgtgactgccagatgtattccaagcacttcttggaaaaggttatggtttactaaccaatggccttctcttgttaactccgttaatccaggaacctataagaatgagacgaacgaaccacgtttggttattcctatcttcaacaagaaaggagagattgagtcgtttcaaggacgagcactacgaaaaaatgctccacaaaaatacatcacaatcaaagcccatgaacacgcgaccaaaatttatggtctcgacactattgatgagtcaaaactcgtattcgtcatggaaggaccaatagattcgttgttcattgataacgctattgcaatcactggcgggtctttagatttagctcaagttccatgccatgataaccgagcatggattatggaccatgaacctcgtcatcccgatacaattaagcgtatgaaacgtttagtagatgctggtgaaaaggtagttttctgggataagtcgccttggaaaagcaaagatataaatgatatgattatgaaagagggggcgaactgcttctgaaataacggattatattaatcaaaatatatcgcaaggtttaatggctaaattgcgtcttgacaaatatgcgaaggtataggggccaaagccccctaaacttaaagtaatcctccggtcataataaacgacacaactttttctaacggcattggaggaagaactagcccgtgtgtgctagctaatggaactaccacataattccatgcagctaaagcagcagtggcgattccgacgtaaagatatcttccaaatcctcctttgtctttacattcttgtttcacttcagacatgaatcctcctgctatttatgttaagtgatataatatttatctaatttaattgaaaggaataaaataatggcacactttaacgaatgtagtcaactgatcgctggtgcagataaagctgaagctcgatacgcaggtatcgtacgcaaagttggtggtgaccctctgcaagtaatgcttgatatgcaaaaatctcttcaggttcgtcttgcaaatgacaagcctggtactaacatgcatcctgatgaattggctcaagctggtgatatcgtgcagtggctgcgtaatcaaaaagattacattgatgacgaattccgcgaattgctgacgtctcttggcggtatgagtaatggtgaaaaggcggctagtgctgtgtggaaaccatggaaagctgaccacgtcaagatgcaggaaacttatatcaaagacctgtctgataaagaccagcttgaaatcaaatttgaaatgattgatatcctgcactttgttctgaatatgtttatggcgcttggtctggattctgaagaaatctttaagctgtattatctgaaaaacgaccgagaactttgctcgccaagacagtggttactgatggccaaaagaatatctaagcgtcgtttaaaaattaatcagaaaacaaaaagaaaagggccttagtattggcccttcgagaagaaatcactcgagaaattgataaagaaatattaaaggtgcttaccgcagctatataaatactcctagtaaactaaataggagattaaaatggcttacgtaaatatcaaaacttttgaccatacaactgctgatggtgaagt

SEQ ID NO: 663 - DNA, 4769 bp, Klebsiella bacteriophage F105/15
aggaaccaaactttctaatttaactcgtagaaaatgtctgaatctaaaataggaataaagtggtcagatgaaagaaaagagctgcacaagttgtatgttaaacgcggagaaaaccatccaaggaaaaagaggactaagcaaagagcataaactcaaattatctatttcaggaaagggaaagcatataggatttaagcatacggaagagagtaaacgcaatatgagtgcttccaaaactggaaataaaaatcctatgtttaggaaaaactagtgcaatgaaaggaaaaccagcacctaacaggaacctatcatggaaatacgcagatgaattatacgagttatggatttccaataatatgccatccgagtatttagtttaaaaagatagtaattccaatgggttatccgcaatgttcatacaaaggaataatttcaaaatggcagcaaaactccactatttatacgcaagcatgaacgcaggcaagtcagcccatttactattatcagctcataactataaagaacgaggaatgggaactctcattctgaaacctgctattgatactcgggattcggcaacggaagttacttctcgtattggtctacgtcatgaagctaatacagtagacgaatctattgacatacttgaatttttcaagtgggcacaaacacaacgtgatattcattgtgtatttgtagatgaagcacaattcttgactgctgaacatgttcttcagctatgtaaaatcgttgacttgtatgatgttccagtaatggcatatgggcttcgcactgattttcgcggcgagttattcgaaggttctaaagctcttctttctgtagccgataaacttgttgagctcaagggcgtttgccactgtggacgtaaggctacaatggtagctcgtattgacgaaaacggaaatgctattaccgatggtgaagtagtagaacttggcggtgaagacaaatatgtttctctttgtcgtaaacactggtgcgaactggtaggtgtttataatgaagccaagaacgtataacactatcctgatgctaattatgggtatgctattcatttggattggtgtagcagcatctatacaaagtgatagacgagaagaaatgcaaaatcgtcttaattccgaatgtaaagtattggcacagggtaaagactttattgctaatacgaatgggtgttatattaaacatgagtagcttatttgctatagcgggtggtatagtattagtactcgtgattgggttcttactatacgtaatattgctttcgttattggtttaatatagaaaaaatatgtgatgtgctatcgttgtcttcatgtatatgattacaacactgctccaaagacggctaccaagcgtacttaaaaccaaagaacctgaatgtccaaaatgtaaatgcaaggtcatctattcatgaatattaaatttttcaaatcaggattttactatcgttgaggtaatttaacttaacgaggtaataatgtctagaacaattcgccgtaaaggctggcatgtagtaaaatcttccaaatggaacgatcagaataataacgaatttgcttatattaaaagctataacaaatacgttaaaacagttaaagataaagaaaaccagcagaaatatgtagaattgcgtatttctagaaaacagggaaagaccgttagaggccaagaaactgatcgctaaatcaaagcgtgatggattctaggaaaactctgcgctggacgcgctatgcaatgccggttccgcgtttatttcataaagccgaaattaaacgtgcattgaagtatgatgaagaatataactgggacgaagcaggtgctagaaccattgagcaaggcatctgtgaatggctttgggattaagtaacacatacttatataaatactattactaactgatgaggtgtatatgcagcatttaagtgaaaagcaacttcgtaatcttactgtagaacaactggacgaacttcgtcgtgagattgggcatggtatttcgcaccttcaggaagaaattcgtcaacatagttcaaaagcagattatacccgtaaacgtaagctggaaaaatacctcaaagaagttaaggctgtacttcagcacaaacgtaatactggacaaaaataataggaggccgtatggcctttaatcacatttgcttagccctggtgttgggctgcgggatttcattcccagctgcatcacacgacgacatttcagattataattcgtatgttgagggagctctacaagtttatgctaaatttaaagagcctagtaagcaagagtctgaacagttctatgctttcatacaaagtaaatggaagagcgagtcttgttctaaagattgtgattctttaggacgttcagcaggtgaagaatacgctaaccgtatgaggatacaactcgataatgaagttcaatgattttgtaaaggacggtaaacttactccgcaagatgaattcatcggtttacttatggcgtctcaagcgtattttcattcagcgcattttgataccaaatcgtatgccagacataaagcgtatgaagttttctttaacgagattccagatttgatagatgcttttggtgagcagtggctaggattctcaggtaagagttatacaccggctttaccatcgcagaaagagctgccaaaggacaccattgaaatgctagacttcattctggctaaggccgatggtatctacaagtccgttcctgccgccctccaaagtgttctggatgacattacaggtctatgctacaagactaagtatttgttatcattgcagtaataccctccgcctcctccgggaggcattttcttttcaaaaagttgtttacttcccttcattacatgatactatagacatatcaacaaccaaacgagaaaaacattatgattaagttaacccactgagcttcaacctggaaaaatcttttatcacgtgtgtggtgttaatcgcactgaaaccaagtctggttctatttcgcgttacattgttgcatcaggcacgtatgatgttgaacttggtcttcgtggcgtatattcgcgaaaatctcctttcttccaggtgatttgcgaatatgaaaactatgctggccaaactgaaagctattcaactgagcgttctgctcatgatatgggcgtattcaagccaggtgaaaaacgttcggttcataatcttaatcgtgggttttggacgcgtgaagaagctgaacagttcattaaagaactgcaagaagataagttcagcgatccagatgaccaagcatacgctgacagattaactcctattgaagacttccgtcgtcagaaagaatttatggattcttaccttgactcttgtgattacgattactacgactttgatgacgaaaaatgaaaaacatcttgattattttatacatggtagttcaatatcaatatccgatgtttacttacaactttgttaacgatttgcttgatttaattatagcgagtttgaaatgaacggatggggtccatcggatgacggcttcgcaactcgtgaagccactatagcagacgggattgaatgggaccgtctccagaaacagcttcaagaacaacgtgaatccgaagagttttgcgttgactgtgatgaggaaattccaatagctcgtcgccttcttgttaaaggctgccaacggtgtgtagaatgtcaaggaaagtgggacagtgtaatgacttctgcttataatcgtcgtggttcaaaagattcacaattgaggtaattatggaaagtattcttgatagtaccaatttagataatccgtacagcgatgtgcatgtaaaggttgtgaattcgtatttcactaaaaagttgagtcgtatcgtgctaaaacaaggcaatgatataattcatcttgatactaaacaaattgattcattaattaaattcttgatagaggcaaaagatggcgagtaaattagtatgggacggaaaatcccgtaaaggcgatgcagtaattgaagacgaaagtccatacattaatgatttgcatctgactaccgtagagctatacggttctacacttattgaaattgagcgcaacggtactatcttgatgattgataaatccgatgctgaacagctcgtaaaatatcttgtaactatgattccaactatgaaggactgataatgaatattaataaaaactcttggcatttcaaaatgaacctgtggtttaaatctgacaacatgtggaaaatgccaaaaactctgtgcggatacttctggacaacagttcttcatgttgtgttttcttcggcgattattacattcatcggttctgttgcatggatgttcggttggccgattgtggcagagacaggaattctcgcttggataggtattagtttatccacgttttggttaaacgttgtagcagtaccagttggcgcagcggttatagcagcatttgtgcttttatttgcagctatagcttttggattttatttttggtttagaaaaatttaaacattatcgtatccaagaaaaagtaatactaagaaactcgctcgggtaaaagctggtcttcctgcagaagctgaaccgtcggtattcgtccagtatttaaaagctcgtaagcggaaagtctgcccaatgattgattatgtagaaggtaaaactagtgaagaatgatcaagtttatattgtgaacggccttcgggccgtatttcgtgctaaaaccgaacgtggtataatttctacataccctatt

SEQ ID NO: 664 - DNA, 3997 bp, Klebsiella bacteriophage F105/15
attaaatcgccagcagtaactgattcattagctgaaaccccaccacccagacgaataacaccggaaaatccttcaggccatccttgcgcagtagcaaatatataacgtgaagaacctttggagaaataatcgtccataaagatgttatttccgtagatgtctttatcttgacggtttgttgataacaccgttgattcaactaccgcgccatctctacgaacaatgatagcgtactgagtatcggtctgaggaccatatccaaatacggcttttgcggttgatgcacgctgtccaccactcggataaatcgtcagttgttcgcctttatcaaaagcggcttttgacacaatttcaatttccagttggtttccgagctcgcccggatacgcagctacaattccaggcattttatattgcgcaagcgcagtctggaattcggtttttgtcatttcttcatgggcagtttcatgctcagtcagtaaaactgtagactcagaaataattttacctaaagtaatgacagcggaaacaccagaactctgcgaagtaatggtagttgtccacgaagaccctaaatctgggtactgattaatgctttttgcatatgcaataatctttgaagtcggaatgaacaccgacttaatttttccgtcactatctacctcagtaactgaaccggtgtcatctacagtttggtctgcatatttaaccgtaattttatcgccaacttcatagttactaccagcagtagtgatagtccattcaatattatcaaccagcggagatgcgtttttagcagcttcacggttaactacacggacggtgcgtagatcattaccatattgcagaaagttcattgctgacataaagtaatcagcagtttggttattaggaccaccaaacatatcaaccagttcaacttcgttagtgatttgggtaacttgatatgcaggaccccattggaacttcccgacaattgcggcacgacctgtagcgttaagtactaccgtgctctgtacgctcgtttctttgagctcaattccaggagagactaaaggcatgatatatcctcaatgttgtttgtctttttattatttatacaaatgaaagaccatgttcttgaggcgcatattctgcgctattcacggcgtcaacgaacactacaggagcgtaatcgtcgttcatatcttctaattcgcgtttaaaaacttcagatgctaaacgcatttcatctttatccacgaaatcagcaaatttttgctgtgttgttaaccatgcgaaaattacgagtgacataattaaatcgtcatgatatccatcttctgccgcccaggatactcctttctcagagaaagtacgaaattcttgaacagtagcacgatggtgaataatgagtttatctttttcgataaggttcttttagtgcagaacatccgacggcttttgaccttttcgtctgtttcattcctaaatcaactattgaatcgcaaatgacattctcatattctaaatccatataaagactcttcgctacagaaacacctgtagagttaagttctatatagatcggagcttcgttgtactccattagatatttaataactatatccgggaggattaagtgagaaattgtattagaatgtaatactccaacttgttcccattcagatgtagtcacgtcaataatatttagtgcatggtaatcctgaccgcgtccttcagcagagtcaagagttgcaatatatttgtggtctgcttccgcttctttaaatttataaaacccgtgcgagtcaggagtaacttcaatccaatccatattggcaagtttcataccggaaatgagagtaccggatgtgccatgaaattccgcacagtgctcttgtttaaactgttcaagagaagaagcactgatagtttgaagtgaccattgccacccatcatcaaacatatcttcgtcgttatatagacgttctttaaccgagttccaaattgcagtataaggcgtaaagccggatttaccttcaaccgctgctgtccaaatatcatagaagtggtttaatccacttggtgtagtcgtgataataattttagaacgacgacctgatgaaataacaggttggatagcaagccatgcatcgatgaagtttggaataaacgcacattcgtcaatgtaaatcattgcaaatgagttaccacgaacggcatcaggactcgaagcgtatgccccaatagatgagccattatctaattcgattgagcctttgttccattcaacaataccaggctgaagaaagtcaggaagtaattcaattgcttgcttagtacggtcgagaacttccgcagacattgagcctttatgcgcaagaatacctactgctttatccttattaaaacacacgaagtgcgcaagaaagattgctactacagtagttttaccgagctgacgactgaggttacaacaagtcatacgtttggctgccatgatttccagcatgtccctctggtaatcacgaagctggactttaatggtaccatagtcaatgtgagtaattgcacagtaggtctctgcgaagtacacaatatcgtctcgacatttcttccattctgcaactatttcacgcgtcaactgcattttaatatttgctcgtttaaggtttggcaatcccatatagcgggtgcgcttattatttttgtccttaaacgtttggaaatgagctgggtcttcaccttgcaaacgaattttaactatcccatgcaacttaagatagtcttcaaatttctcaggataccacttatcatcccattgcgatttaaagaaacgaactccgttttcaattttcgtttccatttcagacgggtggcgaataaccacctgtttcccgtcatttaaaggatgggcatcactcagaacgttaaacggttgagtctgttccatttactattttctctcgagcttcttgtgcttcataggcatcaccgaattcatccatcatatcagcggtagaccctacaaagactgttgcattttgaatattcattccttgatgaggattagctccctttccggtgccaacctgctcagaagtaatgtctttcatttctttatgaagcttaagaatttctttgttggttgtagtcatctgacccataagagttgcaaatacttccatatgtctaggagagtcagcattcttagcagtttccaaaaatattttagctgcgtccattaacatctgttgttggaagtgcatattcttacgaacaacagaatagtcgtcttcgaggtcaggtttacggtcatttggattagatttaacttcaactaattcaagtttttcataaactggaatttcttgtccttctattccaggaattccttcgatgtctaataatttagccatatctaattgtaattcactcatttttcacctctcggtccaggagcctccggatttaccggaataggaatatcgtgagaataagtttgtttactagaaccatcccaattttcgtgttgaacatctcgtggagtgacttcgctatctactgattcaaagtttccttctggagttagctctttgctgttagcgaagaaatctaaataaatggttctaatttcgccgtcaacttcggcaacaggaggatataaccatccattgacttcaaacatcaatgaccattctaatctacgacgagtaatattatctccgtcaacagcttcatccggagaaaatgactgtaatacaattctaacatcacgattaaagcttgtgtctttgtcgtaaagttcagttatagtcgtgttaaaatgcggctgaaaataaggaacgatttgctcgatgatttgatacatatcatcttggttgcgcgtataaattcccaattcaaaaatacatcttaatcggagtaggattatactgagatgtaatttttgaaggggttttatatgatttggttctattcaactgtgatgttttatacatcgcgttgtattgca

SEQ ID NO: 665 - DNA, 3940 bp, Klebsiella bacteriophage F105/15
cacccgaagatttgaacagacactaaatccatggcgttcagcatattctgcattttagcgaaagaattcttgtacttcttcatgataatctcatgaccaaagaaactttcaccttctaaaataggaccagtacgcttagccggaacgatttcggtaggagtaataatcacactaaagttagtgccatgaatcttctcacgagctacccactcaacagtatgcatatcaaaaccagcaccacgaatcttctcgatgaacttaccgttgtaatgattctcgagactagaatatttctcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattagctcacgcttacccgctaaagcggttttctcaatctgagttaatacttcttcttttgctgctgataattcttctgtggctacgttaatagcagtattagccattctatcggcaaggttcataatttttctctcaataaataaaataaaaccaggagtccatctattttagacaagggtaatggtatcagaggatttccccctgagcccattataccacatcgatttttaaagcaattaatatccgcttggaacaaagcgatacattaatttgtcatgtttatttcgcatgatttcaaactgatttttatgtccaacttctaatactaacggaacatttacatccattagcatccaatcaatttttcctataccgttctttaatcaaatctgagattttgcgtgcgccatttttataataagtgctatcgaatattcgaaccatcatattatcaacaaatcttgatgcagaacgccaataattaatattgctcgcagcaggagcaaacttacgctctaggaacatctcaaatttctctactactcttttatctactttagacattataaagtcctcatgtgtttaacaagtttcttatgacgagattttataccaacgtttgttaagcgtttacgataaactactttttctttttgcttaaaccgttcgtgcgctttctcaaccgagacccacaatttagcagcttctgctggagtgatatctaatgctctcgctaatttcttgaaaatctttaccgctttcatgcatcaagtgagcttgtaatgctttcataataacctcatctatgtgacgaggacataataaaccaatccgtgaatagcaaaaaagggagcccgaaggctcccgaatattacggatagataatacctgcttcaagcgcagtacgatgaacaatgtatccatttctagattcttgtacatcgacttctggataatcatctagcattttagccagagtataccggtgtaggtaataatcgctatcagggtcgtcgagtttccaatctttgccctcaacagtcattcgctggatttcatccattacccaccatccacaccagatataggctgttccacggaacggtagaggatgaatatacggaagttctccgtctggctcaggggctacctttttagtaaaaacaacctcgacacctttagtagcagtagccgggttgtaatctgctgcagaaaccgtgacttcgcaatttaaagtataattagcctctgccgattcagttacggtaattgttttagcagtctgaccatcaatagcgtcagcaccacgtttccacacataagcaatgcttgctcctgctggtgctccagtaacatcagctgtgactacttgggattgaccaatttctttagaaacagaagttgggctcaaagttaaagtaatggccggcatagttttgttcttaactgtcagagtagtttctgcttcagccgtttcaggatcgccttcagccggagtaacagtagcaactactttaacagttttactacctgcaggtcccgcagcaacataattcatagctgcggtaacagaagattgttttacaccatttacggtccatacaaacgtttctgttccttcagctgtggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaataaattaaactaaacagtgtctggtgtgctgatgggtgttcaaacgacgttggccgagatttccaatctgggttatctttaatccattggtaaatccaccatggaagggtgatatatcctgggttcttacctagcaactgcatgtttggactaaagttttcaggaagctcaaaaatttcttctgtgttaataattttaactactttgtccattgctttggagaattcttcagggtccgtgatactaaccggaatattggtaacttgtccttcatcatctatatgaataacgctgtctccaataggagcttcagcataaaatcctttatcattgatagaaggtgtttttacttcaaaacctgggtcatttaccttaggggtttctttatagaaacctgggtcaatatcatgaattttaataccaacattaactggagcgtcaaacagtagttttgcctcatcagacgcttcatctttaaatactgctttaccttcaatttcatcatctgcttggattaaatcagcaattgacagcccatcattatcttctggcataggctcatcggccaatttagccagttctttttctaagtcagcaaccatattgtcaaatgaacgggtctttttcagtttaataccgaaggtttgggcatactcgtcgagcttgtctttagcttcttttttattcgagtgcctgaatttctttgatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatgggcattgggatggacgaattcgtctgctagattataatcgtctcttaccgtttggtcttgttggccaaattagaaaattcgctgaccaattcggatataaggtttatttcgatccagctatattcgagcaagaaactctttcacgggaggatttcgacacgtggttagcatctaaagaaatctattcaggattaactaagattgaaccccattggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctactacagcgttagttgaccagatgattgatgatttttgtgattatcgtttatttcctcgcaatgctatgctgggtattcgaggtggtactgctcgtgattcgaatgcattagtttatgtatctacctggcagaccgctgttaagcagcctaaagaatggttttctcaattcggcatgatgatgaatgatgaatgccatcttgcaacgggtaagtcaatttcaacaatcattgcgggtctcaccaattgcatgtttaagtacggactgtctggttctcttaaagacggcaaagctaatatcatgcaatatgttggtatgtttggtgaaatcttccgtccagtatcaacttccaaattaatggaagacggacaagtaactgagcttaaaattaatacaatcttcttaagatacccagat

SEQ ID NO: 666 - DNA, 3831 bp, Klebsiella bacteriophage F105/15
tatttggtgaccgtgaagcattgcgtgtaaaccttctgattgctggtgcttgtgccggtgaaaccgatgaaatcgcaagtacagtacaaaaacacgtttcgtctattgcagatgagcgtcaagactgtttagcactcatttcgcctccaaggtcaacgattgtaaatattcctctgactcgtgctgttgataatttaatcgactggcgtcaaggcgatggaacttatgattctgccaatatgaacattaataccacgtacgcggcaattgatggtaactataaatatcagtatgataaatataacgacgtaaaccgttgggttccactggctgccgatattgcaggtctgtgtgctcgtactgatgatattgctcagccttggatgtcaccggctggatatcgtcgtggtcagtattttaaattgcatcaaattggcaattgaaccgcgtcaggcacatcgtgaccgcatgtaccaagcaggtattaacccagtgactggtcaaggtacaggtgaaggtttcattctgtttggtgataagactgcaaccactgttccaactccgtttgaccgaattaacgttcgtcgcttgtttaacatgctgaagaacaacatcggtgattcttctaagtggcagctgtttgaattaaacgataactttacccgtagttctttccgtatggaaaccagccaatacctcgcaggtattaaagctctgggtggtgtatatgacttccgagttgtatgtgataccacgaacaacactccagcagttatcgaccgcaacgagtttgtagcgagcttctacatcaagccggcacgttcaattaactatatcactctgaacttcgttgctacggcaactggcgcagattttgatgagttgattggaccacagtaatatgaaccccaggacattctggggtcatctaatctttagatgataaattatattaccgcacactttaatagcctctacgatgatgtagtcaatcgagaggctatataaatatctataggaaacaacgatggaattaacagacatcactcgtgcgtttgaatctggtgactttgcgcgtcctaacctgtttgaggtagaaattccttatctgggtcgtaacttcagtttcaaatgtaaagcagcaccgatgccggcaggtatcgtagaaaaagttccagtcgggtacatgaaccgtaagattaacgtcgccggtgaccgtacttatgacgactggactgttaccatctataacgatgataaacacgaagtacgtaaggcaattattgcttggcaggctcaggcccacgcccaaggcaatgatatctctggtatgactccagctgattacaaaaaggttgctactgtacgccaatttagtcgtgatggcaaaactgtcacaaatgaacacaccattactggtctgtggccaactaacgttggtgaagtacagatggactgggacagtaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgcagtttaatgaataactacgaagttgacaatgctgttgaagaaatagtttctgacgcagttgtatacgaagatggtcacccagtagtttctcttgatttagattctaccgacttcagtcaagcaattaaagatcgcattcttgaagaatttaatacagttttaacatgccttaatttcgagagaaagggcgctgaccatttccgccgttggtatgttgactcaagaatattcttccataaaatcgtcaacaccaagaaaatgaaagacggaattcaggaactgagacgtcttgacccgcgcaacttgcaattcattcgcgaaatcgttactgctgatgatgctggtactaaaatcgttaaggggtacaaagagtatttcatttacgatactggcaaagaaagttattatgcagatggtagattatattccgccggaacgaaaattaaaattccacgcgatgctatcgtatatgcacattctggattagttgattgttcaggtcaaaacatcatcggttatttacaccgagccgttaaacccgccaaccagttaaagctattagaagatgcgttggtaatttatcgtattactcgtgctcctgaccgtcgtgtgttttacattgacactggtaatatgccttctcgtaaagcggcagcacatatgcagcatattatgaacacgatgaaaaaccgtgttgtatatgatgcatcaaccggtaagattaaaaatcagcaacataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccagatgcaaataatcaaggtggtgtgcagtttgatgctggcacaacaattactcgtgatgagcttgattttgctaaatttattcgtagattacagcataaattcgaagagattatgcttgatccacttcgcactaatctaattcttaaaaaagttttagtctaaagatgagtgggaagacgaaataaataatattaagattgtgttccataaagattcatatttcaccgagttgaaagatgctgaagttatggagcgtagaatcaatatgctcacaatggctgaaccgtttatcggcaagtatatttctcataagacagcaatgaaagatttccttcagatgtcagatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagctttggtgcaattatggctgaacggacatctggtttaattgaagagcgacaaaaaatttatcgcagcgtctgtcatgattgagggtgaagagcccgatgaggacgaagatgaagacgacgaagacgaagataagtctgatgaagacgaagacgacgaagaggacgagtaatgcttatactgcctgaaaatcatgaattagttatcgacactgtcgaagctcttcttcctgaagcccaggcacgttttgataagttgtccgcagcgctctctaaagatgatataaataaaattgtagagaatcttgttgtttctgagcctgatttagcaattgctttaggttcaatcaatgaatctctacaactaaatgaatttatcgttaaacatgttgattctaaaggtactattacacgtactaaggatcgtaaaacacgtgagcgtaacgcgttccaaacaactggactttctaaagctaaacgccgtcaaatcgcgcgtaaagctagtaaaatcaaaacgtgctaatccatcggctcaaattcgtggattacgtaaacgtaagaaagcacttaaacgccgtcaggctcgt

SEQ ID NO: 667 - DNA, 3631 bp, Klebsiella bacteriophage F105/15
cctcgtgacttgatagcatccattgcatcactacagaactccaaaagaattccccaatattgcaatttagtatctacacccaagatttctttatcagcgcttaaaacagttttcatttctgatttttcatatacatccatgcatacttcaccaccaacctcgccacgaccagtgtaataatccaatcgtgctttaagattttgctttttgagggcatctaatcttaacatttcctttcgacaagtcgagtgcttacgcacccatttcccgtacagaacagggttattagccgcttcatactgtaacttggtctggtcgataatcaaatcattatccaattcatcctgtaattcttctaatctcattctatctccactctactgtttcttgggaaggactagtcccattatactctactgctagagttagcattactacgcatctgtatgcgtatacgttctagcgtatcagggtcgtctactatagaaaactgtacagtgacaattatagcattatcgtcatataacggaagtacatcaaccgatagacgattaatcctaggctcataattacgcacagcagagactatattacgctttatcgtatcgccagttaatggagtcatgttttcaaataattcgtttgtgatatcacaaccaaacgctgggtcaaatggccgagacccctttctggtggttattattccaagaaggctatttttaaccgatcgtgctcctaccgtttttgacacatcagtatcccaagcaagtcgcatctctgggtcaaggtcagaatatagtttatcgatattgctcatgacataatcttaaagaattctttaagccccttaattacatgaatgtgagaaattccgcattcacaagtaatgggaactgctaattgaacctgcggcttcaatagcatatttttgatgttaactacatcttcggttgtaatagcagaatataaatcatcgatttctgcatcgtttaaatcattaaagtaaatctgctcatttccaaccacgatataatctatgcattttgatatcatcattggaatgtctgaatcgtcaaaaagattcggatacttaaactttatcttgaatccctttaagtcataccagaggtcttctggaggatcgatttgcgcatgtgtataatttaatggcacaggaattttacgcccacaggtgcaattccaggtcacctcatgattaacctcgcctatactgtgcgcccaaagtataactataagtaattccgattcttgtttgtttaacccaatagcattagtgcattctctgagcaatgctttaacgcattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaacaaaaacagcttatagcagaattaatggatgattattttcatgaccatcctgctgagtatcgtccttatatatttcttaaggtatttctttcaagtattggtaaaaccaaaatacctgtcagaatgaagtgcccaaaatgcggaaaatataagcagtatctttttaatctttaccaacctccgttggtaaatccaaaagtagaggttgctggattaacgctcaggttacaaaaaacccatagaaataattgacgatacaggtaaaatgattttagacaacattatatctgtggaggattcatctggggaatacgtgtggaatgaattgagcgatagcaataaattgaccgttatcgatgctatagatgttgaaaccttggaaaagattttatcgcagatgaagccctttaattttgaattaaagacgtcatgctgtgataccacgacagtattaaaatatgataacattgtcgatatttttaagctattgttacatcctgacgagattttcacattttatcagattaatcatagattggtttctcagggtaaatatgatttgaattctataatgaaaatgctgcctatcgaacgtggcataaccttatcgcttattgaaaaggaccttaaatcatgacaacacaaagattaggatatcctaatataagcataaaattatattctggatatgatgcgtggctagctaatagattcgttgaattagcagctacatttattacattaacaatgagagattcattacgcgggactaatgagggtctgcttcagttttatgactcgaaaaatatgcatacgcgcatgaacggtgatgagttagttcaaatatctgttgcaaacagtaacacatcaagaacacaaactcgaatttacggaattaaacactttacagttggtgttgatgataaaggtgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactcttaaagattacttacgatacgttagaaacgtaggcatttccacggacaatgaccaatttatttttgtcctgggaagatatcactgggattaacatgatggattatgaatcaatgatatcccaggacccaaatgtattcatgtttggagctcctcaaacaataggtcagtttgcagcaggattaaaatatccattggcatgggattttgaatggcttgttaagtcaaatagatataatagaaatcccatgaaaaacgcaacattttatgcacactcgtttgtggacaaagatgttacccgaattattaatggagaaggccaaaacagcgtattcattaataggtcaggcggatattctgacatgatttttagaaatggctatgaagaagcattgcgcatttctacgatggctcaatatgacgggtatgctcaaactaaatgttacggtaattttgaactaactcctggtatgaaaatcaattttgttgatttaaaggaccagttcagaactgacttttatatagatgaagttatccatgaaatatcaaataacacatctataactaacttatatatgttcacaaatggctctgcccttgaacctgtagatttgattaaggtgaaaaatgaacttaaacgtgattcttcctattaagaaaatagtaataaacgaaaagacgatatcaattccaaaacttggattaaagcaccataatctgatgaaagatgttaagggtccagatgaaaacatgaatcttcttttagattcaatttgtccaggattaacagcagccgaatccgatatcgttgtactacatttattagcatttaacaaccgaataaaagaaacagttgttaaagatgattttacctacgatttgaataaagttta

SEQ ID NO: 668 - DNA, 3463 bp, Klebsiella bacteriophage F105/15
aactgaaaatagcgcagcataataaaatagccgcttttttctattttgacgatagtcctgacatataacgagccattaattggtcacgatacattaaacatatattttcgttaggagcattgacacataaatctttcatgctcttagccttacgatttattagtgttgtccactgggccgggctacgtgaatcttttactccatcgctgaatgctgaatctaattcaagcgctaatatatcaacacattcagagttcgtattgcaaaatgttttagcgatacgaagtgaatctgtcattgaattttcagcattagcagagaatgccaataccaatccaagaagcgcggcgtactttaccattattccacctttgtatgtagcattttatgtttctttagaaattagctttctctaggacatctgatgcataagagtttcctcttttgacattccatcctgcgttataactagcaagagcttttcgcatattgccgttatgtatatttaaccaatatgaaagctcaatatatgcccattccgcggaattctgtctagatttaagcatttttcttatttcagaatcactaaggtttttgccctctaatttagctctggctttaaccgtaggcaagtaattttgaaataccccataagaatgatgcccctttcctgcttttaaattggctcctgccgaagattctttccatgatatagcagccattatatatcctaagccgttattatcatatcggttatgcggagatttttcctttccggatttttgatattgctcaccaaaattatatgcgtaatgcaagttgtcaagttgaacattactgaaagttggctcagacccaaaggccgttgaacataaggccattagaccgataagcgcttttttcatgtttacctcaattaatgtgtataacttttgtgctgattttacctttcaaacgtttatcattaacgaatgccatacgacactttatactaggtccttttcccggtcttggaatatccatagtaaatcctaaccacagatttccatccgtaatttctaaccgcattggcttatactcgatgttttcatcaatgtcttttgggtcaattggaagccaaggcattgctaaaaattcattaatttctttaagatgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtgtgtagggccatagtatcatggcccgtaaggaaagtaaactactttttaatatttttcttctggctgaaacactgaacgacacgcccacatagaagcttccttcagtttctgttttgctgtacgaatctgggcaatacgctcgtatgcttcatcgagtacctgctcaggttcattgactgacacttggtaattaattaatgcctcttcttcaagagcagtaaagataagaccaagacgggtctcagcgtctttgatagcattcactttaccaatcttttcatcggtatgtggcttatatcctttaatatcttcaattgacattatagtgcctctgtgaaagtacgggcgatgacgtcgcgttgctgttccgacgtcagggagttgaagcgtaccgcgtagccggaaacacgaatggtcagctgcggatatttttccggatgctcaaccgcgtccagcagagtttcgcgacgcagcacgttaacgttcagatgctgaccgccttcaatttttaccgttggctggtattcaatttctacttcacgagccttgtagccataaaaagtttcagcatccgtaatagtatcttctttaagaacttttgaaacgattactcgtgcgtcatcaccatcttcaatgtaaatagtgcctttaagttcgccttcaagaatttggtatgctttcatatttccccttaattagattctttattccaaccatgcatatatgcagtaactacactcattttattccattcgtctgaatgaaacttcgcagctgcttctagataagttattttatcttcatgataagtaacttcttcatctagtttctttatcgtattccacaatttcaataggctcgttaactccatatccgcgagtgcctatatacgttttagcttcttcccactgttttgtggtttcattccaagttccgttctgatgggcttcatagaaatcttgctcgccagaattactgaaccattcacagaagctctcaactaaatgtggaggacaccttataacaatttcagccattgcattgttttctcttgaatgcgttggtcatatgtgattaagcttgaactaatcacgcctttgagcttgccagatataaactcaattctaaaattaggatagcgattcatccacttcgtgttaggagcattagaaatgaattctgcgcctttgaacggaccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcaacgaaaaataaaggcaaggtatcattaggcatagaccatctgatagcttcctggtacatatcatagaacttcatcatatcgggaactttcattggttcttcaatgataattaatgctcttccaagctttcttcctctaaacttataagaggaatcattggataaaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattgacataaggcagcagtctttccggtttgtcttccaccgtctagacgaagggtaccgtactctcgcataaggcaagacggttcataaaaactgtagttgggattattcaatcgtctgtctgcagcgtctctgaaagcatgcatcagggtcaaataaatgggagttaagtgtttcattttagattccagttaaagggccattccttggcgcgtgcttagtcctagtaatattcttaataggtatagacaataaggtctaaacgtattcacggcctcccttaagggtattcattcgtacttttggacccggagcagaatcatctacctcgtaagctgccataacgccccaacgcctttttaacttttagccaaagaacctttggatacaac

SEQ ID NO: 669 - DNA, 3449 bp, Klebsiella bacteriophage F105/15
attaccaccagactttggttctacataagccgcagacagggtttttccttcaggctttggagccggaacgccatacgattccatattacccgttagaataatcatggaaacacgagaagcacgaccttttgtctgattaaaccaaacagagtttcttgcttctgtataagcggttttccaatcaccaatgagcatggcatcaagcattttaccaaattttgctaaaccgcctacacccatttgaaagctcatattttctaaagccatctgccttgacttgttgactttagcatatacaggtcctacgcgtgaatttgttttaatgtcagaaagcattttatcacggtctttcttaaatagtgcaactgcttcgtccattgtaatgataccaggatttcctgtaacggtacgaccaacctgatttgataatgttttattgatgacagacatatcacgtacttttgttgccatgataaggtgtccaatacctacagtaggatatccttccgtgtcccagtaaacctttaatctaagaccttcgtccctattaagcatatctgttattgtaattgcaggatttgggtcttcaggaatgtcacttaggtcagcatcgtcaggattaataccaatatccaagtttctatcttgaatgatatttggtatagcactatacccggtttcatcgccttgaactagcgggttagtatctgacccaacctgtctaggatattgacctgtaggatcagaaaatccttctgtatagtttggcttggtttttcttatgcgcagaatatgttcctattactaatcccgctgttttgaattcatcaagccataagccaaatactgatgttccttccaccattccggttatagatgagccaactccagaaattccagctgagttggtaggctgaatcactgacatccaaggaaggtcttcggtaggaagaccggttatagctccttgcaccttttcaaatggatgaagcccataaacacgtactcgcactcttccttgctttaatgggtcttgtctgtcttcaacaacaccagtaaaccattttaatgaatcattcatttcaatcataaaacttctccgatggtagtctgggatttgtaccggcctgattcgtattcgctgtcaggtgctttttccatttctcgtataatatcagaaagaaatgcttcaatatcgctaggattgataatgtttatttggcgcagtttttcattttctataatagaatcttcgtaaatgtcaacaccagctaaagccccagtatattgagggtactgatgattaaagtcccctttatcataccaaatgcctgaattttcaggatattgctcgaggttataataacgattgccgtttgcatccacgtgatagagtatttggtctccacctacatctgcatatttttgctgtgcaaattgatagcatgcgtcttgtgttttaatccaatctctgaatgggtcatatacattattacacattaaaagaatccagtacagctggctatttccataaagaatatgtgctaattcttctggtctaggagctccacttatgtaatatgtttgtaaaagatagttttctgctacagtgtcgaaatatttgcgataattacgaaatatgtcagcggttgggatagcttttgccttagcaccttttacggtctttgcagaataatctatcggactaaaaaatagagaagagcatagtttattcctcttataaatattaataacagtatttataaggaggccactatggcatattccggcaaattcatgccgcagaatctccacaaatataaaggcgacttcagaaagattacttatcgttctacgtgggaacagtacatgatgagatggcttgacaatcatccagatgtagttcaatggaacagcgaagaggtagtcattccgtactttagtaatgcagatggaaagaaacgccggtatttcatggatttctgggctaagttttctaatggtcagcagttcttttttgaagttaaaccgaagaaagaaactagacctccggtcaaacccacaaagttgacgacatcagcgaagaaacggtacattgatgaaatttacacatggtctgtaaacgttgataagtggaaagcagctcaagctactgccagtaaaatgggtatagaatttaggttaattaccgaagattcaacttaaaaaattaggatggaaaggctgatggctatatttgaatttatcactgaagctgcagaatcgcctaaagctaaatcccgtagtgaaaatcaatgggtagcattaggagttgaatactctgctgctcgacaaaaaaggcatgacgtctaaatcattcgctgaaagcaaaggaataaatcctgctacgttcagtaaagcaatggctcgtcatgcatcaagaattaaaacggcaattaaagtagcagaaattgagaaaaaacctagctaacaaaatgaccaaacaggagcgtgctcttgtgatggtaaattcatttcgaagctctatcaaagataaaattcgtaatgaaggcgcagcagtaaacaataaatctgctaaatggtttgcagaaactataaagaaaaatatacgtggtcattctgtaaccaagcctcaacctggaaagctatatgcttacatgtatgatgctaaacataaagacactcttccattctgggataaatttcctttgatagtttatcttggtcttggaaagcaaggtacaaccacattgatgtatgggttaaaccttcactacattccgccaaaggctcgtcagcagtttttagaagaacttctgaaacagtatgctaatacgccagtgatatctaataagaccagattaaagataaactggagccaagttaaaggatttgctggcgctgacaaaatgattaaagcatatattcctggtaatataaagggtgctttaattgagataaagccggctgattgggcgaatgtagtcatgttaccactgcagcagttcatgtcgaaaggcaaacgctactctgctacttctgtatggaaatcataatgtctactggactgtttaatcaaactaacacaactaactttatattagaggtccctgacgggggcctcacccaagcgtttaaagctaatcttcaaacagctgtagttcctggaattcatattcctgctactgatactgtaggttcgccgcaaggcatgcatcgtgctaaattgcctgggtctacttttgagtttgacgctgttcctgttagatttttagtagatgaaaatcttgattcatgggtacaaatgtacaaatggatgttaagctgtacaaaactacattgaccgagacaagtctggatggaataacggcggtgaaggatttcctggtgctagttttaatgcatgttctgataacgataaacatgatatagtattaactgtccgctac

SEQ ID NO: 670 - DNA, 3354 bp, Klebsiella bacteriophage F105/15
agttcttgatttcgtttggcacccatcatttttattttccactctttacgctgaataaaataccttcgcgatttcaactggaatgacaccatctacatctttacgatacatccaaccatttggtgaacatgaatattcatcagacggacgaggagcagtcttgttaatgtactcacccaacggatgaagtttaaactgtccaacgatggtttctggtgaaatattaacttgtcggatgattgacggatacagagatgtcaagtcaaacgacatgatatagcgatatgcagcaggaactggttccttaacatacgcaccaggatatgactgtttaacatgagaacgactttgcggaataaccttgtcttgttctttcagactgttaaagatgattgcgtcccaggttttaatggactcattacaccttgatacggcatcttcgcataataagacatcgagatagccaggtcaataaatccgcgaacagcatcaatcgcttgtactgattcaacgtcgatgatgttatacgaaatataccgttggtgattagtttcacgcaacttattgatcggaccgtcatatgctaatttacctttcttggtttcataataagcaatgaaatccaatttatacgtcggttggttcgtgaaactaaacttcttatacaaatccatgtaatcaagaatagtcacacccatgatagaataaatttctttatcaccatacatgtttgtgataatcttagatgaaactttattcagaggagagaatcgtttcatcgtacgctcaccaagaatctgtttcacacgattcatgatgtacggaatatcaaatccttcaatgttccagccagtaaagattgctgggcatttctgttcccaaagattgatgtactcaagcatcatttctttttctgaattgaacggcatatatactacgcggtcaagaatatgttgtggaacttcatcaccgccttcagaatctaaacgagcggcaagtttcttgtcccactcggaaacagaaccataaagagaatgcagtaaatcaaatacgtagaacttgtcatcaaccgaatcataatgagtgatagcgtcaatttcatattctgctttcattgggtctgggaattgagatgcagtaacctcaatgtcacagtttgcaattcggatgtaattttttattatagacgatttctgaaccgtaagtatcactgatatacgcgagtttgaaatcatccatacccattgcttccattcccatatcttccatacgacgcatccaatcgcgtgcatctttcatagttgggaatgtatttttcttgcaatacttgccgtagatatctttgtactttgtttcttccatacaatgactaaacatcacaggagaatacggaacacgacgcatacgttcctcgccagtagaatcgatataacgttctacgatgtcattgcctagagattcaacgctaatataaaattctttcatgggtttcctttgtttatagaccgagttattagtctttaggtgggataattatactccaatttttataaagtaaaagggccgaagcccttttcttacgcgccgattgtgtacttagattttaaagtccattcatgcttctgtttgaatgtaattacccggaagttattctgcatctgggcaagagtttgaccacgattaatactcagtagaccccagtcagcgagcagttgtgcgattgagtctcgacgaatttcatcttctaagtcaatggtaacagggcggccatcaagcttcaacatttctttaaaatggacgatatagtaacgaccttgtttctgaagaatgtggcagctttgatatagtactttatctttgttattagcaattcccatacgagtcagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttcccataccgacgacctctaggaacagaggccatcatatagttatagtgtgcttggtcagatagcccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttggtgctcgttatactgatcatcatcttcaaataaactcatcatttccactgcatctctacaacaagttgaataagcatataaaccaaatgtaattcaatcgaagctgctatgccatgatactggttattttcaccgatgatttcatacattcggataatgcttggaccagtaaccagtgtatacagctcagaagaaagtttatctacaaaccaagtatagtctgctgcatatttcggagcaagagcacggagttctttgatgttcttagttttaatagcttcaatgacatcttcaattgagccacggtcatttaaaacaatagacaagatacctgcatcaatcacacccttagaagaataatgatcaagcatgttgatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgataccatcaagattgtttgcagtaatgataatagtacagtttgtgctatacgcttccatgaatgaacgcagatgtcgttgagattctgcaagacctgcacggtcaaattcgtcaatcacgataattttctgcttgcctgcaatagaagcagaacttgcaaatgcagttaacggtccacgaacgaaatcaatcttacagtcagaaccattcacgaacatcatttcagcattaatgtcattacacaatgctttagctactgtagtcttaccagtaccaggagaagtgctatggagaattaaatgaggaatttttccttt

SEQ ID NO: 671 - DNA, 3284 bp, Klebsiella bacteriophage F105/15
gatgaatttaagtcaatatatgccttattatgtcattgacattgataaagctgaagctgatgatagcattgctgtactgaccaaaaagttacagtcttgaaggccatccagtcatgattgtttcttcagatggtgactttactcaattgcataagtatcctaatgttaagcaatggtcaccgatgcagaaaaaactggtaaaatctaaaacaggctctcctgctttagactgcatggttaaaattattaaaggtgacaagaaagataacgtcgcttctattaaagttcgttcagtatttttggtacacccatgttgatggtgagcgtactccttcaacgaaaatgacgtttgttgaagagtgtcttgatgctggcgaaaacatcaaagatttgcttactgaagaacagtataagcgtttcttagaaaaccgtgtgttaatcgattttgattacatccgtgaagacattgttgctaacattttagattgttataataactatcaactaccgggtcgtggtaaaatttatagctactttgttaaatccggtctgtctaaattaatgaaagaaataaacaacttttaaggtgaatataatggctaagaaagaaaaagaagcaagtagtatttgatgaagcagtacacggacaggctctgcgagatatgattaaggaagcctcaggtaataagctaaaggcagaaagctatcttgagcttaacaaagacattaaagaccgcgccaagaaagagcttggtgtagaaggcaaattatttaatcagctgcttgccctgttccataaaggtacacgcgatcgttacgaaactgaaaaggacgaagtggtagaagcttatgactctattttcgcttaaagacggagggggacacactccccctccgaatccattaaccagctgctagataagcaagctaatggatttgctatcgaatctatggtaacagaacttggaatggggtatctcgaggcaacgacacaatggctagaagaaaattctattcctgagggaaacttcagtagatatattccacctgcaatcataagaaaaaattatgtcagaagcattggaagaaaatatgcttcgaccatcatttagtcaaacacataaaacgaatagtctggtattttttatatgattcgtctacgcatgccccaaaacaataatagatacgttaacggtaagagcgtttatcttttatatttaatgctcaaacaacacttcgctggtcgatatgatgttgttaagtataattgggtcatgcgtgtctctgataaagcttatcaaaagcgcagagacaaatacttctttgagaaacttgccgagaagtatacgctaaaggaattgactctgatattcatgagcaatcttgtagctaatcaagacgcttggattggtgatatcagtgacgctgacgcgttgatattctatcgcgaatacatcggtaagttgaagcaaatcaaaactacattctctgaagacgtaaagaatatttactactttgctaagaaagttaatgtagataagcttcatgatatttttgaatataatgagaaagtcggaacatcttatgtgttcaaacttcttcagtcaaacgttatatctttcgagacattcatcatgcttgacttcgtttttagatataataaatactcatgatactgcaacggataacttagtttggagtaattactctactaaattaaaagcttaacaaaaaacttttaaacgttgacggtgctgaagctaagaaactctttattagcataatcaaatcttgtaaagaaattagtatataattaatctatcgtccagttgcaaggacccatgttgcaacaacaactgttaaaattaaaaaggtaaaatcatatgtttaagcgtaaaaatacctgctcaacttcaacaacaactggctggtctgaaaggtggttcttctttctctaatgaagataaaaacgaaatggaaactgaagaccgataatgctggtaatggtcaagcagtaattcgcttcctgcctggtaaagatgaaaactctctgccgtttgtaaaactgatcaatcacggtttcaaacacggcggtaaatggtacatcgaaaattgtacttctactcacggtgattttgattcttgcccggtttgtgctcatctgagtaaaaacgattcttataacagcaacccggctgaatataagcttctgaaacgtaaaacttctttctggtctaacatcctggttattaaagacccggctaacccagaaaacgaaggtaaagtattcaaattccgtttcggtcagaaaattatggacaaaatcaacgcgatggttgaagtcgatgttgatatgggtgaaactccggttgatgtaacttgtgtgtatgaaggtgcaaacttcgtcatgaaagttaagaaagtcggtggtttccagaactatgatgaatgtaaattccttggtcagtccgagattgcaaacatcaatgatgaagaaactcagaaattcctgaccgaaaatatggctgacctcagcgaaattgttgctccatctcagtttaaatcgtttgaagttaacgaagccaaatttaaacagattatgggtacagcagctcttggtggtgccgcggcgaaagcagcagctcaagccgataaaattggtgatgacctggattcctttgacaaagacctgtctgattttgaatccaaaccgacctcttctcgttccgcagacgatatcatgggcgatgctggtgacagtgttggcgatgacgatctgaatgatattttgaacgacctctaatataaagggaccttcgggtccctttttctttatccctccaaaaaatattttcacaaaattgtttacaagccagttgatgagtgatactatatctacatcgaaacaaaacgagtagaggaaaacatcatgggtaaattaaacattgatatcgtggcagaaccttacattaataaatcaggattttgtactgatttgatttttgaagatggttcacgtttttatgacactgaccatggtattgattttgatttagttattaaagaaggccctggtggtggttggccaaatattgacctccgtggttctaaagaagcggttcgtgcttggttagaagcaaacgagtgggaagatattgatttgatgatggaagactggaaagagtaattacctttggggacttcggtccccactttgaggaaatgacaatggcacaggttactgtagaaatatatgattatgaacacttcattgaaaccattag

SEQ ID NO: 672 - DNA, 3236 bp, Klebsiella bacteriophage F105/15
tattttaacttcaccaccattagcatatataatattctggacagaaatattattgctaaatgcagtatcctgactaaatgaccaagctccagaaatagtctgcgctatatcgcgacgagcatatttgtctggggtttgaccacctagcattccggtgtcataggctttaccaagacgaggtaagtaatgtttcaacgtgaggttcaattcatatggagacactgcgacgcccttagaggcatacccgttatccggaagagttgagccatcggtatcattacctttccatgttccatcgcctgtagatagcctcacggtccctctaacgctgtctgtagcttgccatgactctgttacctgaatagtttgttcaaatagcaggaggaacaattctatcacttagcgtgcctgcatcaacctgggccgtgtgtagcgtactgagcaagaccgatagctccttcggttgctgttttagcatgcagcgtggcagcagtaactattttcttagcatcggttccagttctaacctcagcagcagtagcaagagtagttgtacctctttgcgatgtacttgcttcctgtatgttgatggtataatggtcccagaggttcccagtaatagttaagccagaatcagtattaacttggatacgatcagtattagcaaatttatcaaataataatttagggtttaccattactatacttgaagtaccagcttcaaattcaccctgggcaccaggtgtcgcgaagcgagcaataccagtacgatcgttagttgctgtacggtcatttaatgttttaggtgtaactgctttattagtcacgtcgccagcattaacttctgtctgtgtagctatttggattaaaccaattgctccatcagtagctaacttttttgtgcaaagcttccggtgtaacaaccgtaggaatatttgaagaagcaggagtcccgtttctaacttcgctatcagttgctaaccaaactattcctgactgatttacagtagctttatactcgcgaagagtttttggagtaactgcatttttgtaatcagaatgatcgaatataccggtgccagcagaagaacgatcattagttgtgttaggagcaccaccagtttttactaattgaataacacctaatcgtgaatccgatgtagtgcgataaagcaacttcttaggagtaacaatcgtaaaatcgtcttcgcctgcgtccattttagcattagttgcaatctctgctaaacctctacgggtttcagtagcagctctttcgttaagctttttaggagtaacgattacattatccaagtaagaggcagtcgttgcctgattaacttcgctagaagttgcaattcttgctataccggtttgggtttcagtagaacggcgtccgtttaaggtttctggtgtaattgctaattctttttctgcgtttgattcagcattagcctgagcttgcgtagcaagagcaataacacctaatcgtgctctggtagtgttgtctttagcatcaactcgttctacggtagggtcagattcagttataatccaattaactttttccagttgctttttcttcaatataagcaagttcaagtactggaacatatgacgtggttccgttaaaggtaatcgagcttgattgcacccatgctgcatcaggtggatactctgaacgttttggaaattgcagtaaattcaaattactcgcgatggtatcaccatcagaagctttaattactacagtctgtcctttacgcatataattcattgcgattgtgacagtatccccaacagctacgtctgtaggcaaagtaacgttaattgttttaaccgtgttattatctgcgccaaatacagaaatatgctcattaggcattaaagtaacgtcagaagtaattattcttactcgggtgcgtaaatcattttcaaaaatacgccagattttgtcaatcgagtcatataccaaaaacccattacctgaagtacgtacttgaacctctgtttgtccaggagtcccaattgagatagttgggtcaaacgtacgcacagtcatatggttaattggcgaagtaccatcaaggtcagtaaaattaatgatatcgtttgagttagcaaataacggcagagtaatgaaaatctctgagttggaagtataacgacgaactacgttatcacccgactgtacctgggttggaacaatcccgtttggaactaccattttagcagtatcgccaaaatcggttaaacttgcacgccatgcaccattactaaacgtaagcataatttgtgaatacggacgtgtaagtcttacctcacgcagacgcgattcaccaaatacaatagacgcaccagtatcctgtgctttaattaaaattccgttatatccagggcgtccaccgatatcacgaactacaatggtatcgccttcatccggtgctaaaggtaacaacagcgtagcattacctgcagcgtttgagtcaacgttgatgaactggccagattgaatttcaaactctcctttacggacagtataaatccagttcgggtcaacacgtaaagaagtccaattggcctgattaaattttccggctggttttggaatatctttatttgcaatccagatacgacgtccataagtcacagcaaaatcggtgagatacccacgcgtcgggtcatatttttggtatagtattttcttgaataacgtactcgacggagacgccgtcggttttaacgttgcggtcagcaagtgccacatttataactttatttccgccggcatccaaaccgtttgttgcacggaaatgttgtttcagtaaatcgctcatagagtctcctatggggttatgcttcattatagaagtatttataatggctgtactaactaattgaacgaggttcaaatgtctgatttaaattgcttattcgccgaagaagaccaagtaaaagaaggtgtcattctgattgacttgtcgcaaattgcaatggcgacaattcttcatacttataaagaaggcgacaaactaaccactcctatgattcgtcatcttattctttctactttaaaatttaatgcttttaagtggaagaaagatggatatactaaaattgtcatctgtgttgataatgcagttaatgggtattggcgtcgggatgtagcatattactataaaaagaaaccgtgctaaagcccgcgaagaatccaattgggactgggaaggttactt

SEQ ID NO: 673 - DNA, 3201 bp, Klebsiella bacteriophage F105/15
aatgactatgcgtggcagctctacgttttggaacagttaaccaacttctgaatgcatcaaggtaaaattattcggttggtgacattatttggaacgtcgggtctttgcacgtatattctcgacatttctatctcgtagataattatgctcacacggtgaaacccacattgacaaagaaagattataaaggtgagtggaagtgattccacgtaagtctggatatcatcgtcatcatataattccaaaacaacgctggaggaacagatgacgatgataatatcgtatatcttactccggaagagcatgctaaggcacatctggaattgtatgaaaaataatggaagatatgaagatgcgcaagcgtttaatactctttctgcccagtggttaaatggaagaacgatatctggatataagcaatcaacagagcatattaaagctagaatatcaaaaattgattatagtaaagtatcatctaaacttaaaggacgagcgtctccaacaaaggggatgaaattcgtctttagcgaagaaagatgcaaaaacatttcaaatggattgattggaagaaagctttcagaagaaagtagaaataaaattgctaatacattgcgtggtagaatatcaccaaagagaatagaactttattgtatatattgccacaaaagaatagttccaagtcgctatgataggcatggaccaaataaaagaggatgtacattatgattcagtttgtaattccaagttataagcgcgccggggcagttactgccctgactatgtttcctgaaggttatgttccacatcttgtagtacgtgaatcagaaaaagaagcatacgaaacttggcacggtcatgctgctaaaattgttactgtccccgatgatgttgatggaatcgctggtactcgccgtctgattactgaaatgtatgcagggcagcgaatttggatgcttgatgatgatactaccattcatctgactgaaattcgtgaacgcgacgatcgccgggttccacttggtgttggtgaggcaatgagtcaagaggtatttgatgatatggtcaaatacgtcgagactgctatggattgtggttattatcatggccatgctcgacttgccgattttcaaaattacatcaagctggggtcattatcgcgagaatagttttgggttcaccaatactttctatgatttgactaaacttacagcagaagatattggttacggagttattgaccttaacgaagatgcttatgcttttctaaaattaattaacatgggtcatcctcatctggctctgtttaagtatctcgttaaatctggtaaggtgcagtctcctggtggttgttctacacagcgtgatactgctcgtcagaatagagcccttgaacagctgcatgctgctttcccaaatcaagcccgttggaaatctaaagacggtgaaagacgtggtttattcggtgataacgaacctctgaaatcaattcgtatgtgtattaacactcgagtgaaatctcaggccttccatgagtttggtaaggtagaaccatatctgtgagggcgaaagccctccaaggacctcttatgaacatctataataaatctgatgtagctggtaacatattcaaggctgaagaattcagatgcttcgtatgtaaatctgatgagtttgttcatgaaggaactactggctcagatggaatgcattgctgttggcatggcatgtgcgttggatgtaaaatacactatgaaatagatacggaaacagtggtttataacaccaagaagaaatggaacttctgttaatagcttcaagaacaaagtaatataattactctatcctttaacctgtgagaaaaatataatggagacttatggaatataatgaatgtctgacttaaaatctcgcctgattaaagcatccacttctaaaatgacagcagaactgactaaatcaaaattctttaacgagaaagatgtagttagaactaaaattccgatgcttaatatcgcaatcagtggagcgttggatggtggtatgcagtccgggttgactatcttcgcaggtccatctaaacacttcaaatctaacatgtctctgacaatggttagtgcttatcttaataagtatcctgatgcagtctgcttgttctatgattcagaatttggtatcactccagcttatctgaaatctatgggtgttgaccctgaccgtgtaattcatacaccggttcagtcagtcgaacaattaaaaattgatatggttaaccagcttgaagctatcgagcgtggtagaaaaagtcatcgtgtttatcgactctattggtaacatggcgtctaaaaaggaaaccgaagatgctctgaacgagaaatctgtcgcagatatgactcgtgctaaaagtctgaagtctctcttccgtatcgtaactccttacttctctattaagaacattccttgtgtcgcggttaaccacacaatcgagactatcgagatgttcagtaagacggtaatgactggtggtacaggtcctatgtattctgcggatactgtgttcatcatcggtaaacgtcaaattaaagatggtactgagcttgaaggatatcagtttgtcctgaacgctgagaaatcacgtactgtcaaagagaaaagtaagttcttcatcgatgttaaattcgatggcggtatcgatccatatagtggtctgcttgatatggctctggatatcgggtttgtggttaaaaccgaaaaatggatggtatgcacgagaattcctggatattgaaactggcgagatgattcgtgaaagaaaaatcttggcgtgcaaaagatacgagcagtacggaattttggggtcctctgtttaagcatgagccattccgtgacgctatcaaagcccggtatcagttgggtgctattgattcaaacgctgcggttgatgaagcggtagcagaaatgattaactcaaaagtttcaactaaggttgatggtgttaaacttcctgagagtggttcagtatcagctgctgaagttgaagatgaattagagaacttcatgaatgaagactgagtttgatttagaatctgaactcgagaaatttgaacaagaatctccctcggaagagggagacttcgagcgtcaagaacgagtgttcaagaaaagccatgaaataatccaagaagctatgaagactgttatcca

SEQ ID NO: 674 - DNA, 2456 bp, Klebsiella bacteriophage F105/15
aatagtatgatactaaatacaccaggctggatttcattgtcaagagaatcggttttggtatgcttaggcgtaactaaatcattaggaattggaacgccttgtgcatcatggtattcatgggcaagaagcttataattctcttgatagaaagcattaaatgcagctctgatattcatcacaatttcctcacaattaatctttgtatgcttcagttgaacctttagcaacggtctcaaaccgagagttcagtatctcaaaataatcctgatacgttccctggagggcttcatagcattcttctaccgtagagtagacacctctgatttggtcagagccaggagcaggataataattagaccaagttaaaagtgcatacattacttacgcttccagctgtagtgagccaaaataagaagcactgcaatggcaagtagtgatgaatgcagtgctgccagtagtgcacctagtcctacacccaaagtaacataatcatacttagttacttcttcacggtttaaatcatagtttttgatgaaccactgcttaatctttttcatgtgctattttatccattatgaaagaaatgatacccattagaaatgcaacacttaacactgatactgtttcaggaagagacataaaggctgcacctataatgccaaaacctaacgctcccatgcagatagttgatgcaacatttctaattaattcacaacgtttcattttattctcctcaagttgatagggttatagtatcactactacaacccattgtaaacaactttgtgaaataaatttctatttcaaatcttctgaccagtccagttttagcggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgcagcaacttcaaaacttcctgaagcacaaacgtatggaacatgaactcttgaatagcatatcgtcgtatgaatcttatgacgaggtacaggattagggaccttcaattcacgctgaaggtcctcaatagcatcaagagttttctcagagaatttagcagctacatatagaccagtgctaaaatcactgaagttcattaggcatcagcttcttcagtagtttcttctgcgaactgtgcttcgatttttgcaaccaggtcatcaagtttaacctgaccgtcttcactgatttcaacgccggacacagcaatcagtttctgtagtacttcttcatactgtgcacgcagagcggacagaccttggatggtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtattcttttttagaaccttcttgctcaggacgaactacatgaataactgtagcacccatcgccctggctacatcaagttcatggtcttgacgagtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacgccaggtaaaggcaaatcatgatggacatattcaatggcattcgccataatacgaatcacgtctttagtagacagatttaaatcctgctcacgatcgtaatcaataccttcaatcatagaccgagtaatgcgaggaaactcacgagacgtatcgcgataccactcagtaagcattgcatcagccaacgcatctttaattggacctgctaactgatgctttgttgcgttatagttatccataatgtagtcagcagttgtatctttgccacacgttttttacctaatcaaaataaaagacttcaaattattacctcatagaaggatgcattcccataactttctgttgatactgggattcgcgagtatcattgacagaaggtctaccagtaattattataccatctttttcaacttcaatgtatttgtactgcaaagttgctacacataccattgctgggtcggattcttcggttaaagaatactcaatttcagataaatcactcacccaacccccgactgtagcggacagttaat

SEQ ID NO: 675 - DNA, 2436 bp, Klebsiella bacteriophage F105/15
tattcaagaagcaacccgtgaactgactgataacccaaaaagagaaagtagtttctctgacagagggcatggattattctgacgcattttcaactaagctgaaagctattgttgaaatggtgcagggttctgtagagcagtctgtaacggaatctgccgatataaatactatcgacaaagaagcagacggtttaaacttcacaactgaagcagtagaagaaactcctgcgactaaaaccccatccgttatggatgcttatgtggcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctcctgaataccgcgatgaaaaaatcgctgaagcatttggttctttcctgtctgaagcagaaattggcggtgaccatggttatgatgcacagaacatcgcagctggtcagacctctggtgctgtaacccagattggcccggcagttatgggtatggttcgtcgtgctatccctaacctgattgctttcgatatctgtggtgtacagccgatgtctaacccaactggtcaggtattcgcgctccgcgctgtttacggcaaagacccgctggctgctggtgctaaagaagctttccatccgatgtacgctccggacgcaatgttctccggtcagggtgcaactgagaagttcgaagcagttaaagctggtgctgctctgactgttggtgatatcgttgttcacgatttcgcacagaccggtcgtgctcatctgcaggttgttgaagatttcactgtagacgctggtgctaccgatgctgctaaactggacgccgcagttactgctgctctggaagctggtaaagttgtagaaatcgccgaaggcatggctacttctgttgctgaactgcaagaagcctttaacggttcgaaagataacccgtggaatgaaatgggcttccgtatcgataaacaaactatcgaagcgaaatctcgtcagctgaaagcacagtattccatcgaactggctcaggacctccgtgctgttcacggtatggacgctgatgctgaactgagttcaatcctggctaccgaaattatgctggaaatcaaccgtgaagttgttgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgataccaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgacctgacgtttaatacgggtgcaacttatgcaggtcaaagtcgggggcgacggaacgtgagtcaattgaagaactcactatgtacaaataaagactcattcaaataaagacgatatgttacaaatatcagaatgtggtctttaaagtacttaaagatagcccgtttaccgatacagcagaaaccgatgaatttggacttgtatctgaagcagtagcagctaataatgttcgtatgctgtcagatgctgcagtcactgaaaaatttgaaggacccgattcagacccaatcaccgaagccagt

SEQ ID NO: 676 - DNA, 2301 bp, Klebsiella bacteriophage F105/15
ccaaaacttaaggtaccacaggttctttttgattaaggtgccgggtaataacaatttaatgattcggttagtacaagggtcaggtcaaggtgatgcagttaagaacattaagatgggtgataaattcattcaggtctatgttttctctgtatccgaaaaaggtaacatcggtgcgcttaaaggtggtttaggccaagacccgattggtgctattaataccatttttgtagaccgtcaacaaagtagttaagcaaattaaagctgatgcggtaatgttccgctttaatccgaagaaaatgcaaggacaagataaagctattcaacgcattcttgctcggttgattactactcgcacaggtggtcgtttcaatctaatgaaagatatggcttactacaaaggtaagtatgcttattctattatggttcgtaaaggtaagaaacttgaagagattgaaggaattcctgaaatttcagaagaactttataccaaagtagattccaaagtaggcgaagtttatgtgtctaaagaaaccggcgaaaacgttaccaaagccgaagcattggctaattccattggcgaaaaagaagacaagaaatctgaactcgctgtaatgagtaaaatgaaagtgtctcgaaaagatttaatccgagcacaatacggcaaattcgtttcgtatgttgatgaagattggccagaaaataaacgtgaacgttggtatgaattaactactaacacaccagtactaaacgcagaaggcgatactgtagacctccaaaaggatattaaatccgggttagaaaaatcaattcctttttatgttgatgatatcaagcactatcgtgttcgtggcggatatggaagtaattttggcgatgcagttgagagattatttgtaggccaaatgtcgagaatgcatgacgactggaaggttttcattccttcaggttcagacaaaatgaaaatcgctgaacaacgaatttcagacgttgctgacgttattgctcaagctaaaaatcctgcatctatggaaacaatgcgtaaaatcgttgaagtagctactcgtggatttgatatgcctccagctgacgatttcggagctttacgtcaataccaaaatcttgtcaattatatgatatccgcttatgtgtcaattgttggcgattctatatccaaagcaattgaatataaccgtgaaatgcaatctcgtttaagcgaagaagaaagagatgcaatacaccattactgcggttctggttattcatttgttaataattatcttattggtatggaaagcttaggcgatccgattattgacaagaaaattcgtccgctcgattctgcctttgaaaaaggtttgcgtcttgaaccgggcactcttttgtatcgtggtcagcgcggaaaatacgaagagtttaaagataacattgagtctaaaatgttttatttccagaactatgtttctacttcgttaagtccaattatctttggtgcttattcaaatgctggtgattcattaatgccagatgctcctagctctgatttagaaaacaaagaaacaactatcgatgcggtatcttccgttattggaacagacaacttggaaagagttgatagaggcgaggaagttgcctatggtgatgagtttaagtttgggttcattattcacggtgctgataaaattaaggtagttatcccgggtgtcttgtcaagctttagcgatgaggctgaagttattcttcctcgcgggttggcaatgaaagtcaacaaagtatggggaactccttttagaaatggagttggtgtagcgaataacaagacattcatggtagaaatgacggtagttcctccagagcaaatcgatgaatcggttcatctctatgatggtgacatcttgatggaacaaggcaaagtggaacctcttgaagaaagcaagttcaaaggctttttaaacgagtatttatttctctccagaccgttctacagataaggttagctacacacgtactatggaactactggctggtgctatcaacctggatggtatcccagaaaaacttgcataaagttgtttacttatcacaaggacgtgatactatagacttacacaaaccaatgaggaaattgatatgaaacatgtattccgctttaacggtattgaatggtctgctgatgttaaagacgcagagaagtttaacgaagaagtgcttatcatgcttgaagggtttaacgaaggtactccgacggttcttattcaagatatcttccgtaagccaactgaaccatcctttgttgaagcggtg

SEQ ID NO: 677 - DNA, 2053 bp, Klebsiella bacteriophage F105/15
gtagtacgagctcctaatttttactggattggtaaaatcaatggcttggttaatagcaaagatttcattattagctgcggaaatagcatcagcgttattcacaagccttgcataaattgaagctgacgtagctccggatttaggaccaacttctttacgcaggtcgtttactcaatagtcagagaacctacgtctgaatcattgtatgcatcctctagcgcctgaatcgctcgtcatgttttactatagctgacgcattattgatgattcggtatttcataccagaacctggagcgtcttgcttaggctgtccgttaacatcttgcccaggatacgcaccaatttcacgtttaacccaaactatattatcacgaactgttctgtaatagtcatctttactagaatcataaacacccacatcctcttcaagaaaatcgaggtcagttctaatctttgtggtgtcttcttctaatttaagaatgttctcactgtgggcttcaatattctttttattgatataaacttgctcaatagcgtcagaagaacctgtgatttctaatgactttttgatttggtctacatctacttgaacattttctactacagctccaacgcgattcaagtcactatgtacctgaacaacgtttttctgaatctgcacagaggctctattcagttctccatcatttccatagcgggttgaagccccattaagaggctctgtattttttatccagttaattctctgttgaaaatcgtctggaattccgtctacgaacggaagcgaatctactagtttggtcatattgttccttacggtctatttgtacagaatgtaagcatgcagtcataaaatataatacgactgtcttctgttggtcttatttgaacagtggcatttggaggaatgttattgaagaaaaagttagctagatgcgtaagcttcaaatctccatgaatgaccattttttccgcctttagtattttcgatgttaagagtaagttcaccgccccattgggaaccgttaactattacaacaaatctgaaaatacgattgtcatatccgtcgttgttacgctcaaattttacgttaacatttagagctaatttactagaagcttcccatggtgcattacatgtaaacgttgcacctcgactaatccaagattgtccttcaacccaagtaacattacctactctagttccagctggcatgtagcgcccgtcggattcttgtcttgtataacaattaatatcattattagtaattgttatgtcattatcaagagtttttccgtttattctacgagttttaaagactgcatctgttgcagcagccgccaatgaagcatcagtagttggagaacctgataatctggttaatccatatttatccttggtggattttaacgcttgaagactttttggagtaactgccaggttattagctgttgctgtagtaacatctgaatctttagcaaattttactataccaaatacactgtcagatgcttttgacgccatgaatgtttttggagttactgcgtatccatcatgaacaacacctgctgctacctgggcttgggttgcgacacgaactagtcctaagttgctttctgttgcagaagtataagtaggaggattaacgctgaactttccaatcatttctacaacacgcttaggagttactgcagtggtttcatcagttcctgcttgagcttgagctgcagtcgttaacctaacagttccatcacgttttcttgggctttcacagttttaaacacatgaccaagagcagcagctgtaatagttctgtttgctgctgttaatgctgcagcttcggtattagttgcgtatcgggttaagccaagaattgcggtagttgcttcaggccgagtaattgtggattttaatgtagcaggagttaccgcagcattaccaatagttccagcatcaacttcagcctgtgttgctgtgcgaattacaccggctactgtaggagatgctacaggtaatccggtatcagttcttgcccagctaccaatcagctct

SEQ ID NO: 678 - DNA, 2031 bp, Klebsiella bacteriophage F105/15
aaaattgataaatggcagacccaggttaaatcacgtaagcttaaaacagatttaacagtagaattagcccaagatttagaagctaatgggttcgatgctccagaacttattgatgatttacttgctactgaaatggcagaagacattaataaagacatcctgcaatcattgattacggtttcttctcggtttaaagtagctggtgtatccgataagggtgtattagatttaactaaacaagattctgctccggaacaaggtcgtactctgtaccgtttcatttgtgaaatgaattcagcagttcaacgtaatacttcttattctggtacttatgcagtagcatctactcgttgtgctgcggtgctggcagcttccggttggttaatgcagaagaatgatggcactattccggacaacgcgtacggtatgctgaataacggcttacctctttattgtgatactaacagcccagttgattacgttattgttggtgttaaggcagaatttggtgggaaggaaactgtaggttctttattttatgcgccatataccgaaggcttggatttagacgaccctgagcatgttggtgcatttaaagttattgttgacccagctagcttgcagccttctgttgctttactggtacgatatgcgctgtcagttaacccatatactgtaggattggacgaggacgaagctcgtgtgattaatgctgcggatatggataagatggcaggaagaagtaagatgtctgtactgctcggtgttaagttacctaagcttattgcggactaagtttacggggagcttcggctcccctttttgctataaactaaatatgtcaaaccgtcggggagtattcctcctcgagggatttaaacacgttcttatcatagaggttgacgcattctattccatgtctacgggctatatcaacagctactctcgtccctccagatacactcccgcattcttttttcaggcgcccaatataataccttatctacaggctcagtgcattctaggcccaatacctgcatagaattccgtgcgaataatgtctgtactattttcgagcattcgtcccagtacgacgtaacttctctcgccttaatgatgcttttgattttggcctcgtttgataattcagaccatacaacaacacctgtatcaggaaagtggccacaaaagccagagtaaggaataatcctacaagaatttgacctatcgtatttcgccaaccacgcttcatctgaacccggagctccacctgaatatagaaaaatgcccctcttccgagaggcgttgaccgattatagtcattagactcagaactctgcgtggcgcttctcttgaaccaatcagcgccagcctcattattctaaaacctcatgccatttactacgaatagtgttttgaattaaagtagtgatttctttcttaacagcagaaggattatcagcgaatagcatgtcatgaccttcacgtgctgcttcgttaatgatatctttcatagtcagacccataacacgaccgaaatctttagcagttacagtaccaatatgagacagaacgttacttacccggttccaggttacatattcggaaaagatttccagaacacgcttatcattctcggtgagttcaaccttcgctttaataggcttatcggatttagccttctcactgaacttagaattcttgcacttaatagctacacgggtaccgttattaaagaatttaggattaaccggtttaagaacataaccttcagctacgccggtttcagaagaagcctgtggaccgaacacatgtttatttgcatgttcaaggtcagtcgtgtcaacaagttcattgtagtaattgacaatagatttaaagtcatttacatactgagataactcagcgaatgaaccacgaccaagcagtggagctaatttaagaccaagaccagtagcaaacgattctactacgtagtcgtcccaataaactttttctattaccagagtccgacaggatatcaaacacgta

SEQ ID NO: 679 - DNA, 1902 bp, Klebsiella bacteriophage F105/15
caatgaaatccagcctggtgatttagtatcatactattgcggcgggtcactttctgcagcaagcgttggtattttgctaggatttacgcctaaaggttatcgtgtggttcctttccatacaagtccaattcctgagcaccgggtattgctctctcatatggattcaccacatcgggtattcctggttaaatcaaagagctcaccgattgtgtaatatgtttttaggttttctttgttattattaatctatcaactgctctgattaatttcagggcagtataaataaaattacctaatggggagttagaccgtaggggtagcgggacagactgtaaatctgttgctcaaaaggctcgagtggttcgactccattactccccacctatttttagggatactagctcagttggttagagcaccggacttttaatccgggtgtccgaagttcgaatcttcggtgtcccaccaattagggtcgttggctgagagggtaagcgacggactgttaatccgtgtcagaaatgactaggcaggttcgatacctgcacggcccgccaaatgaagaagtcagaagacgttctgataaaatcgtcggcacagaaatccctggcatggcgtttgtattaaggagtatgatttcatcctgcttaatgcttgttcatgttataatttcttacggcgttgaaagttcgctttcagggatacatcttagaacagagtgctaaacaagattcatctggtaccaaggtgatgagagtcctgttccccctttgcttcggcatcgtgccagagtatctctgaaagcgaattatggacctatagtttagttggataaaatactcccctgtcacgggagagagcgcgagttcgatcctcgctaggtccgccaaataagaacgtggcagttcttgaagatgagtttgagtcctgtaagataatgccgaggacgaagcggtttgttcccacggaataagctctatattcgtaagattatatctttagcgtgttctacatcaagctacttgttagtacttcaagaacccggataaatgcggggtaacttcagttggtagaatgttgggctcatatcccgacacgcgcaggttcgagtcctgcctccgcctccaacaattggactatagacaagcggttaagtcaccggcctttgactccggtatctctggttcgaatccagatagtccagccaaattaatattcattcaacgcgtctacaggggttgaactgatcattcttctcttaatttcgtatgaagtcctcatgatggatggagtgaatattgatgtggccgtagttcagttggtagaactcagcattgtgattgctgtcgtcgacggttcaaatccgtccggtcaccccaacaatgaaggaatggtggaaaaatacacgacccacagtcatgctgggttgtcgctaagcgaattgtgtctatatggcacttccttcaccaaatactggagagtagcgctagtggtagcaaaccggacttgaaatccgggccatcggaaacggtgagggttcaactcctttactctccgccaaatttatgaaagttaaaacgctgcccatagcagtggtacatcaacaattagatgattagctttccatgggagtatagctcatttggtagagctctcgaccgataatcgagcggtgactggttcgagtccagttactcccaccaaataacaggttcttagtataacggctattatgctgggctccaaacccagtgatgagggttcgattccttcagggcctgccaaatttgcatccatcgtatagcggatattatgtctggcttccacccagaagatggggagttcgattctccctggatgctccaaattactctgtatagctcagtctgggtagagcgctcc

SEQ ID NO: 680 - DNA, 1836 bp, Klebsiella bacteriophage F105/15
aaggagtttttgtcaattggtctaattcaacctttaagtcttttgtcaacctctggagataatttctccaattctttatatctggtggttgtgctttgtactgcatccttagcagagtctaatcgagtggaatcagatgcgtctagttttttcaacgtacgcttttgttcgcttgagttctgcttcagcattattacgagctgtgatgattttgaggcgttcgtcttctggcaagtctgcatacgctgactgctttttctctccgctcagcaatttattatattcatcgtcatcaatctgaccggtgaatttttggaatttagcagaaagctttcttttccattcaggttgttcgtcatattctctttcttgacggtcaacatattttgctctcattttagcatcttcttcatctagttctgctccagtaacagtttgaaatctgtctaaagcagcgccttcaatgttatctgccgaatcgttaaatcctaatgcgcgcaacattccagcaagaagcttactcattccgagcataatagtttctccgagcttgtcaattacatcaaccaatccagaacctatggctttagctaatccgccccaatctcccttgacgaatgattttactatttcattcgacatctcgcttattgctgttaatagcggaccccattctttagcctgcttgttaaattcaacaaagttcttttcgaataatttagtccaataattaaaatgaactttaattaaatctataagcattatcacgcccaaaaccatggcggcagttttcgccatttgagccaaagcgctaacagtatagctaaatagcatgctgctaatcttatctgttaatgaaatagtttttccaaaaccagatttaacgattttaattaattctccaaattttaggccaagaaactttttattcttatcctcagtttctttgttaggttcttttctttcctcttgctcttctgtgttaggaaagaaatccgcgtcaggacgtctatcatcctgtggaggaataagcctttcgagtaattcctccaatggctgctgagtaggagcatccgggacttgttctgttatcgtttctaatgatgttccagtacctagtttttggacatcttgttgaacatcatgtctttttagataacaagtcagcaagcttcgtgagtttatcattaattaatgatgcagtatcatttagtttcgagacagcatctgttgtgcgttctgaagacttctgcggtcaattcgacaccagctgaaacatcttctactgatttgataatttcgtttgatttagtttctattacatccgaaatcaaatcagtagacgcttgttggtcgtctaagcgacgaccaatatcttctagcgtattaatctgagcatcagcttgagactcagcctttttctgtggagccgagtcagcaataactcttctacgcattgaattcatttctgatttcttagtcattcaaatatttccattacgttaagcatgcctttgattggtccttcaggtccatcaatagctatagtgtttactaagtcatcagcccactttgtcacaaaagctggaagcttcataaagtttatatccattggttttccatctactgattcaagaaattcgctcaaaattgaatctactgaacctagtttggaataacgaggaggagctctgaatttgaattctttaccatctaaccgttgagttaatcgttggcaaatgtaaactttattcaaatcgtaggtaaaatcatctttaacaactgtttcttttattcggttgttaaatgctaataaatgtagtacaacgatatcgg

SEQ ID NO: 681 - DNA, 1500 bp, Klebsiella bacteriophage F105/15
tgtgatgttttatacatcgcgttgtattgcatatcaaccaagtgcaaattcattcttggcaaaacagtttctatctttgctttattctcggtagacttgatagcagtccattttccgagttgagaaaggaacttttcctttgaggcataagtgataggtactttaatatattttagtccagtgtcttcacgccaacgagcaatttgtacatgagaaaataaatctccaagcaatacaatgtatcggcgtaaggacgaattataccaatgtccaaacatgatttctcctaagggacccaaaggtcccatctttattttatttattcgaagaacccgtcatcaaacgaatctgctttaggaggggactcaagtcctcttccgttattaacataatacggatgaacgtattcagcagcttctttattgattgcatcgctttctgcgtactgcacatcagaaatatcaacaagagcatcaatattttttattggttctaaatcaagttcagagaactcaggaatgataattccttcattgcgctgcaattctggttgaagctgctcaccggaataaatgtatttctgcgcagtaatcttacgttgaacattttgacctaactgataaaatggatcatatggttgaacccaattaatttcaaataacgaattatccataggaaaataaatcaggtcaccagcctttggttcagaattattagtttgatgcttgaataaattgggattaatagtcagattgacttcatcattaaccatcataccaaacttactaaagaacgtgttatcaccagaatatccttcaaatgaatctaaataagcagcaaatttccaagctttggtgaatttacttgatgggtcttctaccgaaaagcaaatccggattgttatattcgcgaggaaggaaataaaactcaattcctctcatttgaatagcctcagctgaataaaacatctgctagcgtttggctatttctgtgattataaaaattcacataaggattgagaatttctgtctcattagttttattgtatcctcggtaatcctcaaggcgagcgaataaactagaattaaatgtagtcatcttttaccccaacagaataggacaacccgggtcaagtaaatcaagttcctctcggagcctctcgatttcttcttgggcctctactttaagtgtttggccatcaactgtaacgccgccggctaattgtagcccttggtgtttaaacagaatttcaccccacaattttttagttcagtgctgtagcataatcttttacccaacgattattataagcaccttctctatttgtattaccttcacctgcatattggccgttattgcgaaggttaggattctgatacctatctcctaagccccaatggtcggaagtttgttcaccagcgaagccgtaacctgcagtattacctaccatcatgtcagtattcataaatgatttagtccagcattcacaaacaatgatgt

SEQ ID NO: 682 - DNA, 1366 bp, Klebsiella bacteriophage F105/15
attatgaacacttcattgaaaccattgaaaaatacggtttgattgaagttagtaacaagtctgccccatggggaggaaacgaaataacggtagaaggtgatactcctaccctatggttatggcttgaacaagaatattttcctggcatggatgatgaatgccgtgaagatacattaactactttcagtgggtaaattatgaaactgaacacagaatatcgcattatcccaagccttgctgccgagtgggacctttcatctagcggaaatcgccggatgcgcttgatgattgaagagcatggtggttcgttctttcctactaaaatgctcgacgaagataatagtttcatcacagaagtaaaatttaaagatggaacaactgctgacgctgaaggatttggagacgcatactttgaaatctctgattatgaattcaaatacttcgaaccggtatatgaaaatggtagtgcaatccaacctggtcctactcgcttggacttgatcgttaccccagaaaatgcagaagaaatgattgacttgatcaaaaaagttttacaaaaagtagtttacaaggagctatgcttgtgatagtatagctccataatctactggagaataaaaaatgaaacttcaacgtcaaagcatcaaacttggttctgaatatcgtggtaaatggaatttctgcatttgcgataaaaacccagaagaattagagcgtgttgaagaagtactgtgtgaaatggaagctccattcactatgggtggtgaaaccgtttattggaatgattattgtgataactgcccatgctatgaagatgggtatggctcaggcttctggattcctgttgacgatgttgaagaattcaaaaaagcatttaaacttgctaaggccaagaaatgattgaggctgaattagtagttttgttaatttctgttactgccgcttttattagcggcgttatattaggattatttttatatgtctaaatttagtgtaacgggatatcctcgcgttaatattcgctgccagtttgatgaaattcctggagtaactcatattgagctcgtatttgaccctcattcgcgatgcaatcaggtttcaggtaaaattgattcagcgtatggcgaatttttaatttaattaccaagttgtgatttcagctatttctggtgaacaagcgggttcgttgtatattctgaaaaaggaagtatttgaggaaatttcagaagccataaaagaagggtttaaaactcttcagagcatgattaaagctagtggatacaagtcatgtggattttaactgactgggattgtaagtactgcggcggtagcctatggcaattaggtggccggtgttttaagtgtg

SEQ ID NO: 683 - DNA, 1358 bp, Klebsiella bacteriophage F105/15
gtctggtgatgctgagacaatcttctataaaaagaattgaacagtttaaagatgattatcctgtcatcgcaagtgtcttggatacttggcggactgacagcaaactcgtcgatgatatcgtaaaaatcatggagctccttgatggagcttctactcaaaattctgaaaataaaggtgaataaatggctgttacctgtctgtctgaaatccaaaaagatgcaattgttaaaaacttcaaaaacggtctgtacactaagaaagagctcgccgagaattatggtgtttctcgtgacaccattcggcgtgtgtttaaagagcgtgaagctcgagctgcagcggcagctgttcctgctaaagtagaagctccagttgagcgtgaatttaaatgggcagcaagttccaaattcatttcaattaccgaaggccgtactacttataacgctgatagccaacatcctgggtttaaatctgcactgcagaaacttgtagatggtgatatcgctggtgctattgaccacattaacctggaacaaggcatcaagaaattcgttcaaggtaacgtccgaattgaagatggtactttattctataaagatatcgagctgaaatctggtctgactgagcgtatcgttcgagccatggaagatggcgaagactttaaacgttatctgcctttcctggaaaacctgatgctgaacccgtctcgtcgtgcagtttatcgtctgtttgatttcctgaatgcaaacgatatcgacatcactgatgatggtcacttcattggttggaaagtagttcgttccacttatatggactgtgcttcaaacacgtttgataactctcctggtaaaactgttacaatgccgcgtaaccaggtagatgaagacgatcagcgtacttgttccgcaggtctgcatgtctgctctaaatcttacatcggtcacttcggtagtggttctgaccgtattgtttcagttaaagttcatccgcgtgatgtagtatctatcccggtggattacaacgacgctaaaatgcgtacatgtggttatgtagtattagaagatgtaactgatcgttggggttcagaacttcgctaattataaggagccttcgggctcctcttttattatgggtgaaacatgattaatccatttaacgtatctcattctaaagttgttaatcttcgtggtactcatcatgctgctgcagtgttttgtcatcatgtagttaaacatgaaggtgatgttcactatgcttgggttgcactgtgatgaacttgtagaacttgggtgatgattttgttgtggaaccagacacttgtaaccacgacgatcgtgtttattttggtgaattacatatca

SEQ ID NO: 684 - DNA, 1253 bp, Klebsiella bacteriophage F105/15
gatttttaaaagttgtttactttaccacaaggatgtggtactatagctctcgaaataacatactgaggagattacaatgaaatcgttacttgctgttattgttgctctcacgctgactggttgtcaaatgccacaaggtgatatcgtcccggcttcttctgttggacaggtgcgagcaattggcggtactgtaggatactatcgtgctagcaaccaggtctctgctgaatcgctcgcggtagagcgtcgtttggacgaaaagaaaaagctaatcctaatcgtcagctatctgcgatggaacttgacatgattgagcagaataagcatgaactggaagaaattaagcgtctgcgtaaaactcaaaaagaacgtacatgtactgctcaagcggcagcagtgaatgaccagattcgtttaactgattttgctaacggcggattgagttataatgagcataaacaacgtatggagcagttaaaatctctccaaaaccacatctacaacaaatgcatgtctaactgaggaaattaaaatggaagcagtatttggcttaatcattcttatctttatctattttctgccgacctttgtagcttgcagtcgtaagcataaatcacggggtggaatctttatcacaaatctagtattcggttggtccattatcggttggttaattgcgctgatttggtctgcttctaacgcacagcagaatacaattattatccagcaagttaaataagaggtctcatgattgtaactccaatgacagtacaagatatccgtcaagaattcgctgatgctttgctcaacaaagaatttgtgattgataagacgggtgtgaagactattgaaatcgtaggtgcatcatttattgcagatgagcccctgatttttggtgcagttaatgatgggtacattgcccgtgaacttgagtggtataaatctcaaagtttattcgttaaagatattccaggtgaaaccccagctatttggaaagcaattgcatccaaacatggtgagattaattctaactatggctgggcagtttggtcatcacaaaactattcgcagtttgctaactgtgcaaaagaacttatcagtaatcctgattctcgccgcggaattatgatttatacacgacctcaaatgcagtatgattttgagcgcgatggcatgagtgatttcatgtgtactaacaatgttcagtatctgattcgtgataataaagttcatgctgttagtaaacatgcgct

SEQ ID NO: 685 - DNA, 1254 bp, Klebsiella bacteriophage F105/15
atgcctgggaaaagctcccaggctatcctgaaactgtgcttgcatcgcaggggactaaaatagaaagtaatggcccattcaagaacaacattgaaatagcatttgttcctagcagtagaaaattgctaatgtcattttataattatcaagataaagatgaccaggtaatagttccacttgtcgaatataacgctcgtggatgtggaatgcagagtgacggcgtttctattgacggagtaatgcaccctaaagaacaaggcgtgttaaaccctatccttaactgtaacaatgctatatttttaagagtatacaataatcttaatgaatatgcaacttataaaattccgtaggtgaataaatgattactggatatatcaagggtaatattgtagaactattcatgaagcatgaatgcgatattgctcatggatgtaattgctttactacaatgggtgccggtgtagctggacagcttgctaaagcatatcctccaattctcgatattgacatcgatgaagaccgttattatgacaataatttagccaagcttggaactcatacacgagctacccacaagaatggcactgcatattgctataatctatacacccagtatgcgccaggtccaaatgttgattacggcgcaatttttaatgcattccatgaactaaattctggtcgtgttgtttataatcgtcctctatacattccaaaaattggagctggtattgctggcggtgattgggaactaattgagaaattaatcaatttagcaacacctgatattgacattatggtggtagaatatgaagaagccaaaagctaaatccatcttgttagaggtaaatagatgattactgaagagcaaaaaactaaaactgtggcagttgattgatgattatgcaggtgctgagcaagtagtagctattagtgccatttacggaaatggtctacctgaagaatacgatgaactcattcgttctaagaaagctatttctgattttatggagaacctttaatggagttaaggcattttaattatttaacgataattaaaactccaaatgcaaaatattattatgtaggaaaacactctactaagaatattaatgatggatattttggtagcggaaagataattaagaaaatatgtaaacgatttccgcataaaactaggttaatacaagaattttctactgaaaaggaagcactaaacgctgaaattgaactagtagaaaaagacaaagatcaagt

SEQ ID NO: 686 - DNA, 1206 bp, Klebsiella bacteriophage F105/15
gttctgaatgataagaagtttggaactatcgataaattcgcagaagttaatgtctacgaagatttctctgatgatatgaaagcagaactgctgacatataccgaagagtgtcttgacaaactgatgtttgaatgtaaacacgctgaaatcttgggtaacactaaccagttaaaccgtaagattctgatcaactcactttatggtgcattgggtaacatttacttccgttattatgatttgcgtaacgcatcagcaatcacgttgtttggtcaaatggcaattcaatggattgaacgtaaagttaatgaatacctcaacaaggtatgtggcaccgaaggacattcgtttgtagtagctggtgatactgactcaatttacgtttgtgttgataaggttatcgagaaggtaggtcttgagcgtttcaaagaaactaacgatttggtcgaattcctgaaccaattcggcaagaagaaaatggaaccatggattgaccaatcatatcgtgagatgtgtgaatacatgaacaacaaagaacatttaatgttcatggaccgtgaagctatttcttgtcctccgttgggttcaaacggcattggcggattctggaaagcgaagaaacgatatgctctgaacgtgtatgatatggaaggtactcgatatgcagaacctcatctgaaaatcatgggtatggaaactcagcaaagttctacgccaactgctgttcagaatgcattggaagaatctattcggcgtatgctgcaggaaggtgaagaatctttacagcaatattataagcagtttgagtctgagtatcgtgagcttgactataaagtaatcgcagaggttaagaccgccaacaacatcggtaagtatgatgatggcgcaggatatccagataaaggtactccatatcatgttaaaggtgctttagcgtataaccgagctactgcaggatttgaaggtataacaccaatcatggaaggcgagaaggtgatggtcatcccgctgcgtgaaggtaacccgtacggtgagaaatgtatggcatggccatcgggcactgagctgccacaggaaatccgacaggaagttcttgtatggcttgaccatagtgttctgttccaaaaatacgttcgttaaacctctgacgggtatgtctgaagcggcagggttagactatgaagaaaaatcgtctcttcttgacatgtt

SEQ ID NO: 687 - DNA, 1200 bp, Klebsiella bacteriophage F105/15
cggtatcagttcttgcccagctaccaatcagctctaacgctgattggacgtcttttatagcaacaggccattgtgtatttgttgggtcaaatattgtatatttggccaaatcactgtagtgattatagttattctgggccattatcccatccttctaaaatagtggaatgtaaatgtgtttgcaccgaatgttttagtttcgttaccaatagcgtcccattgtccataacccgctttagcaggtgaagtaacagtaaactcaacagttaaaccatactttttatatgtttcaaaattatggttctgataatccagatgaataatatcaacatactgaggagttgcaggtgattgagtaacctgttgaaccacctttccaacagcttctaattcttttactttatcataccaacgtgttgctacagctgcgaagtcatcaccattcgcaattctaatcggcaatccgagaatatgaattattactgggtcaccaacagaaccgtcttctttaggttctaacgaaactacacctgaaaaagtagcacgtgtaatttgctgtgctggttgtggagatattccggtgtcattacaaacaatagttccaatttctgctgactgtaatgacattaaatcattaatagcagcttctgcgtttgggtaccaaacacccaaatccatttgctcaaaggttaggctccctataggagccttatttccaaccgcgatattctgcgggtctacacgatattctagaaaaagcagttaatcttgaattaactttagctccttcacgtagttttagtttcaatagtcattttaacctaccctaatccaacgataaacggtgattgttggctgaattttagtgatgtcatttggaactacaccattgtttactgcaacagtgtcttctcggtatttagaataacctggtccctgcgcgtctgggtctaattgacatccaccaataactacgcttccatgttcagggtctgaaattagaactttgtcccttgacattagttcaggaatgtgttcttttcctaacgtaaatgtcaaatctccaaccgttccacctgctgttaatgatggctgaccattttcgtttaagttattattgttacgcgcaaaataagggtcagatgaatcattattccagcccgcagtaacacggccttgtgaataaagcttccacacccc

SEQ ID NO: 688 - DNA, 1172 bp, Klebsiella bacteriophage F105/15
atttatggcattgatgaacaaagccctgcagagattgaaccaactccggacatttaccctagatttgaataagctaaggggtgaagacaaaagtaaaaatcattgatactgccagatatagcttagatatcgatccatctcaagatagaattgacgttcttaaacgatgcagaattgctataccggcagagtatgtggtagcagattttctcgatggatacgtgaacgatcaagttgttgaccataataacaacgatccgtatgaatgggcctgggacgtattagctcatccctactaccaaggtgttagagttgaagttaaaacacactttgttcatgaccgagcaaatcataagccatggattaatgttacaactggtaaagacggtccattcccagatggaagtggaataaatctagggcccatgtttaaacataaagtcgcagactgtataattatattcgttgcagaagaagtgtcccagaatgtcatacggtacacaccaatgttcgctggaggtatcgaacacctcatggaagtagtaaaaccttcgcgagttggagctggcgggtatatcatgcacaaattttaaaaagttagtttacttccgggattggccatgatactatggccttacaaactgaacgggagtaaaacatgagttacttagagctaaaatcacttcgagccaaacgcggaaatgcttctattaaagctgagcttttgaaagagtataagattcttgaatctatgaattggcattatactatcattgcttgtgataacggtgattcaacgtatggcgggttgtatcctaatggagctgccgctgcccgtgatgagcacatagataaagttaaagccttagaagaaaaaattcgtaatttgtgcatttaatagtttactttcttgttctccagtgatactatagtcttgttagctaaactggagaacaaaatgaaaaagttacttacgattctgaagaacatctttgtagtattctgccttatcgttactttcattggtgttttcgcatgggatttggttaacgtttggattaatgcatttatctgaggaaaatataatggttcgtaatagttttgatcgtcgctttaacttaatgagaacagctgttctgtctgttattgttgcggtagcactggggagttgt

SEQ ID NO: 689 - DNA, 1105 bp, Klebsiella bacteriophage F105/15
aagcaatcaaaaacgtaactgaactcttttgcttatgataaagtatctgcaatgctggaagaaggacgttgtgtaactccgtctttgcttgatcagtgggaagttgagcttcacggtacgatgaaagaagaaggccaaaaaattggtaaagcccgcatccgtgaattagtggttgcttatcttctgtctgaatttggcatcaaagccttcggtgtagaaccaatcaccccaggtattggtgaaatttctagaaaccactattcgcaaaatgaaaaaccagcgcaagaaaggcttccgcgatgttaaagcggttaaggcggcaaaatgatatcgtatatcgtgtgtgcatctattcctaccgggatatggcatagaaggattaaatgtatcagagcacattctgaacctgatatcagtcaggctaaacgaatactcaaaatcaattggatgaagatactgatataattattagagtatttccaattgattcatctactctagaaaaccaacttccatctccatcagagatgtggcaagaaggtttaaacgagcaagaactgcgagagtatcttgatgcgtaaagttattctatatacagaaatttttactaatcgttgggtatttgatagtattttgcttgctgatacaaagtttgctgatgatatcggtagagctagaaaattggcatatgagttagcagaaaaatctccaacgtttgtccgcatttcatacattataacaacttctgattatgtgtataaagtatcaaaagaagcactatacagattttgtaatgttatgatttcatctggaaaggcattaaactataatcaattggtggaaattctaaatgactgaagaacaaattacagaagttggtttactcggatggttcatatctaaaacgtctgatggcagaaacacgattgaaactcctaacggggaattcatcattgaagaagattttgacgcgttttggatttatgaacgctctggtgagaatgaatacacatctgtagatgctttctctaaatttgaagatgctattgactcggtgaaagcatggctaaagtaaaccaaattatgattgtagtagaaggcattg

SEQ ID NO: 690 - DNA, 1056 bp, Klebsiella bacteriophage F105/15
accaatgttaagaaaagaaatcgttggattgctaatctagctgctaaacttgcagcgcgtgacgaaaatgcctttgtgatgtttaaacatgtagctcatggtaaagagctattcgagatgattaaagctgcgggtcatgagcatgtctattatgtgtcaggcgaagttaataccgaaacacgtaatgctttaaaggctatggcagaaaacggaaagggaattattatcgtcgcaagttacggtgtattctccacaggaatttccgttaaaaacctgcatcatgtaattttagcccatccagttaaatcgaagattatcgtactccaaactattggtcgtgttcttcgtaagcataaagataaatctttggctacagtgtgggatatcattgatgacctgggtgtaaagccgaagtcagccaatgactaaaaagaaatacacgcatttgaattattgcttaaaacatgcattagagcgtattcaacgatatgctgatgaaaaatttaaactacgtaatgaaaacggtaaatctatgattaaatttgaagatatttacgaagccacaattcgtgaggctactatcgataacttcatgagtaaaattaatgcttgccagaccttagatggtctggaagaactcgagaagtattacgataagcgctctaaagaaactactcttgctgattctgatgacatcattgtgcgtgatgctttggcagggcgtagacaggctcttgaagccgattctgaagatgaagatgacgaagacttctaatacaaaaaagaccccaaccgaacggaaggggcaaagccaattggctacatcaacactagactaattaaaagactgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaggtttatttattacgcgccagcttcaaactgac

SEQ ID NO: 691 - DNA, 1039 bp, Klebsiella bacteriophage F105/15
gcagttactgacgtagaacaagatggagcatacctccgtaaacggggcgaatggtttaaaaagacttcatcaataggtgaattcagtaaagaagatttcactgttgatttaagttctgatgcattggtaaatcctaactcattggtcgctgcttcatttaatgctggcattcgcattgttgatgatattattgttgatgacgatggtgtattttgcgtagaaactgatacagttatcgaagcttctgattcagataaagccgtccaaattgttattctcgtcaataacattgaggtgtttacttatagcctaggtgttaaagcagtaaccggcgagcaactgttgaaaaccaagaaacttattaagttttcgtctggcgatgcaatcaaaattgtgtatagagctgcttcagaagaatcaaaagttcctgttagtattaaatcattggatattactattcatccagcagtataatgaaagggaccttcgggtccctttttcgtataaatagaatataaagaggagcttatatgtcatataacacatacaacccaaaaacgcttaaagacgctatacttcgacgtctaggagcgccggtaattaatgtcgaagtaactgaagaccaaatttatgattgtattcaacgagcattagagttgtatggtgaataccactttaacggattgaataaaggctatcaagttttttatattggaaaagatgaagccgataatgaaagattcttgaatggcgtatttgatttacgtggtcgtaatgtatttgctgtcactcaaatcgttagaacaaatgtaggttcattaacttcaatggatggtaatgctacctatccgtggtttactgactttctaatgggaatggccggaattaatggcggaatggggtcaagctgtaataagagttatggaccaaacgctttcggtgctgacttgggcttattttactcaattaatgacttattggtcaatgatgcaggatttgcctttccccacttccagactattggtataactctgataat

SEQ ID NO: 692 - DNA, 1004 bp, Klebsiella bacteriophage F105/15
taatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccgacagcaggattgatggtttattctgactaaaataccagagaatagactgtcatatgaaatggataagttccataacgctcctaatataaaaatcacaggaagagatatggaaccgctggttctttcatttaggatggacccagaagcaagcaactatagagcaatgcaagattgggtaaatgcagttgaagacccggtgactggtctgcgaggattgccacaagacgtagaatgtgatatccaagttaaccttcatgctagaaatggtttaccacataccgtatgtctgttcactggtgctatgccagtagcctgtggagctcctgaatttacttacgatggagaaaatacaatagccgtatttgatgttacgtttgcttatcgtagcatgcaaacaggttcagttggaaaacaagccgctatggattggttggaagataaggctattcagaaaattgagacgattaatccaaatcagggcttgagtgcgtctgcttcaagattgtctcgtttaggcggggcaggtggtggaatttctaatatcactacttcaacaagcagaataatttaggggccgtaaggcccctttgttttatgcaatgcagccaataaaccctggctcagtacgaagaagtttcatttcttttagtagtccaaactactttgaccggaataataccttctgctttaccgtttaagcacc

SEQ ID NO: 693 - DNA, 890 bp, Klebsiella bacteriophage F105/15
gttcaaatcaattgggttccaagcagtcacaatctgacgacgatcagttggcaattgcttaatacggtcaataaccaatttcaattggtcaacacccatgaaatctcgccactgtttgccatacacagggcctagttcaccaccagaatatcccatgtcttttgcctggttttcatagttgtcgtcccagacagttttaccttctagcaatgaaccatgctgaataagacgcaattcatgaacattagtagaaccacgcaagaaccaaatcagctctgcaatgcatgctttccatgcaagacgcttagtagttacggcaggaaatcctttttgttaaatcaaaccgtagctgggtaccaaacttcgcaatagtacctgtcccagtacggtcatcagtctcgtatccattttacaaaaatatctttaattaattcttggtattcacgcattaaatttttcctgaagaggtgtaaagaaaagctgattcccacacttttcaaatcgtccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaattcttttccactttcttttggactttgtcttcttatagctgagtgatatcatagtttgcgctcatagaccacctctgaaatgttagtcacttcatcaatatgataccagtgtattttctttagtaatgaatcctgattctggacaagtaggagctgctacaaattcagcaggtagagtgacatcagaattcact

SEQ ID NO: 694 - DNA, 788 bp, Klebsiella bacteriophage F105/15
taccacggtctaagtcagacgttgattcggttagccataaatttaatgatgttggtgattctcttgttactcgcggcagcggtactgctaccggtgtattaagcaacgtcgcttctactgctgtgtttgggtcgatagagtctttaactcagggattaatggctgataacggtgaacagatttataacacagctcgtagtatgtatgccggacccgacaacagaacgaaagtgtttacttgggatttaactcctaggtctgcagatgaccttatacaaattattcgcatctatgaaatttttaattattattcttacggtgtgacggggaattcatcatatgcaaaagaagttaaagctgctattgacgaatggtataaaggaacacttaaatcggcagcaccagaaggagctaaagtagaaaacactgtgtttgagcaaataacatcgtttttaagcaatgttattgtagtttctaacccaacgatttggactgttcgtaattttggatattctacatcaatggatggtagagaggatatatttggcccatgccaaattcagagcatccgctttgataaaacaccgaacggtcattttaatgggttagcaattgctcctaaccttccaagcacatttacgcttgaaattactatgcgtgaaatacttactcttaatagaggaaacgtttatatcggaggtattgaataatgtttactctcgaagaatttaagagtcaagcggctgatatcgatttccagagaactaatatgttctctgttgtattcg

SEQ ID NO: 695 - DNA, 689 bp, Klebsiella bacteriophage F105/15
attgatactcgtgacgctgatacgctaaatttttgctcgagataatactaactcgtatccgattttaactaccaaaaactacgcaagattagctgacggacgctatgttcagaaagctggtgacaccatgacaggtaatcttaacctgagtggttctgctattgttattacaggttctgaatcatggtatgttccaacaaatgaaactgtactgagacaaggttcttggactgctgaaattaaagacgctactaaactaaaaggtcttcgcggttatatggttccaatcagaacaccgattgaccctgctaacccaagcactttagtagtgactgggtatgaagaaaaaactgcagctggtggtgttttaactcaggttggtgtaactacaaacaatacttatcagctttggacgccttatcctccgacaaccgaaactgccgataagcgtttcgcgcatactgtgtggatgaggatttataatccaaaccttaataagtttgatgattggatgcgagtgttcacgtctgctactcctccgactgcagctgatattggtgctccgagctcagtatcaactcaacggttaaaacccttgaacgtcctggaatggattaagcttggccctaagttaaaatctggccagaccgtaccaaaaccaaactctactaaatttgaagtgggtaggt

SEQ ID NO: 696 - DNA, 602 bp, Klebsiella bacteriophage F105/15
tgacaaaaactccttgattctaaaatatcagaacctgctccaactgccgaagctatacctgcaacagaacaacctgaggttaaacagtctgcttctattaaagccgctgcggatagtcgtgaagctgctcgtacacgtgaatctaatacacagtcgcaacctattcaggttaataccgctgtaaataagaatagcacatacgtttatagaacgcctccacagacttcaacagctgctcctggaatgcaaggcgctatgaaaacctcttaaaggaaaaacaatgatttttgaagaactggccgatggccttgaaaacatcaaaaaatacaggaactcgaatttcccaaggtaaatctaaactgacgaatgcgcctaccactaaggtggcgcagtttccggctgagcgttcggccggaaacgattccgcgcaagatatgagagtacatgacttgtatcgtaacggattattattcacagcgtatgattttaaaggaagaactactcctgatttgcgttcatttagacgagatgtaatgttatcgtctgtattcgattcaccaatgtcagcactggctaattcatcaaattctactacaagtact

SEQ ID NO: 697 - DNA, 560 bp, Klebsiella bacteriophage F105/15
ttttacctaatccagtaaaaattaggagctcgtactactagattagaaaacgattatcgtatagttgacgcaacacttaactctgcacaaaccgggttagttcctcgtgtcaataatattgatgctcgtttggggtcttctgataagcctgatactattgaaggaaaaattagttctctttcaactgaccaaggatacatttctgatgttgtaggacgtgatacttcatcagggcttcagggtcaagtagcatggataaatcagcaagttggtattgttcctagtggacagcaagttcctcctggttcaattttagcgagaatgaccaatgttgaagggatgcaaaactcccaacaatctgctatccaggatattcaagtagaacttggcaataacagtgaaggcctaaagggttctgtatttacattgcagactcaaatgaacggtgatttttcatcagaaaatccggttcagcgggatggtgtgtatgctactgtagtagaattacaggataaatttgttactgcagttactgacgtagaacaagatggagcatacct

SEQ ID NO: 698 - DNA, 304 bp, Klebsiella bacteriophage F105/15
tctggcagaatctcatattgaaaagattgctgagaaagcagaagaaaaagttgaagaagaaaaagaaaagctaaagaagaagctcgcgaagagctgaaagaagctgcttctaaatactttgaccatatcgctgcagaatggatggcagaaaaccagctggcggttgaccgcggtattaaagctgacctgtttgaatccatgtttagcggtatgaaagaactgtttgttgagcacaatgttgtaattcctgaagaatcagtagacgtggtcgctgaaatggaagaagaacttgctgagacaaaaa

SEQ ID NO: 699 - DNA, 9689 bp, Klebsiella bacteriophage F134/15
atctaggaagttcgtcaggcgctgcatgttgctgtaatcaccacgcagcatcagtgtcaggatacgcttggcgacgctcgtgccagtgatatcatgtccggaccaacgaacacggttattgctgatgtcaaccaggcctgtcgcaaatttctcaatcgcttcgcgcggcttcatcaacgtatacgccagtttgatgtcacgagatttaatcgcttcaacgattcggtcatacgactggtggctggtcgtgatcgtttccggtttgccatcgatgacaataacgacactctccggcaggatcatgatctgatgttcgttcaggaacacactcagctctttatcgccgaattcagccttggtctgtttgtcaccgatttgctgcgttttctttcaattttactttgaaagtcacggatgacagcgccagacgcagggtgcgaccgaggatgctgtcgtaataaccaacccggcggcgggcgtccatggagccgcgcatcggatacgtgtcttcgtcaggtaaaataaccgtgatctcagaagtctcacctttgtaaccatcaaccagggcagatgccacttcggccagcgcaacgattttatcgccgtcatttttagaattaaatttgtcggaatactcagacggtttcagctgatcgcgcgggatcatagctgctttgatcccagcataactgctgtcgtctgtataacgcaaacacaggaattggccgtggttctccatgaacttgccgacataccactcttcgtcgtctttttcatatacagccacgccgccttccaggacttcgaattctttcgtagcgtccgattctttaatcggtgaaatgacggtgatgtgtttgctgtttgatgatacggaccatcagcgcacgggcgatagttttggggctgacgccataagctgatgccagggtggtgttgctttccccggcctggctctgagactggatcagttcgatctgttcggttgtcagcgatttcagagaagccgggtcaacccccagctcctggtcggacacacgctgtaccattgagcgaggaacgcccaattcgttagcgatagaattctggcttttgccatccttcaacatccgcaaaatacttttttcggtagcagtcatcttgtagttcccactttgtgttagacggggctattatgccccgagaatacgttttgaaatagcggcgaagaaaccctctttgtcttcttcaatcgggttctgagccacaggcgtatacgtcgccatcagatgttttagcaagttatggcaatcgacacgataccggttatatttcttttgggtctgcgaaatagaacgtgtccagctgatttcgcaataaccgttggttttcagcaattcattgatgctggagaacaattgaatcatacgcgcctgcccatggcggtattggtcaaagttctttttgtatactaacatggaaatttaatttttccatcgcttcgttaagatctttgacgccaggtaatcctttcttgttcttactgatttccttcagataatcccattcagtttccgggattaattcaatattattcttatccagctgggatattctatccttcagataagcaaacttttctgggataccttcgtgagatttggccagaagtgactccgcatacgggatacggtttatgatacaacgagtttgctttcttaatgctaacagttcccgggcattcttagatttgaaatacggcatatggcgtttcataacatttcaaataccgcatcaattggcacgaacacttccgggaactttttctatcattggaaccgatttacggcgggcaaggatgactttcttatggaagttcatgaactcaaatattttgttcccctcatcgtccataggagtgttgtgcatacattccaaaatgctccgggcaacgtattcattaacacgttttccacgaatatcatggatgctgttagttcctgatatctcaatataaacaatttgcttaccagaatcaatgatactggagatatcttcagcagataattctctatccttatagaaactgaaacggaacccttcgtattcaaacatccctggattctttttcgaccgggggcttcacatactgcatatcatgcatgaaataaacttcacttggcacgagaatttccgaaataacttcgtaaaacttatcggcaaataccaaatggtcaatagttgtctcttgtttaccaacccaagattcaaaataggattgaagctcttcgtgattcttgtatgcgtctttatggttttgcaataaattgcgattggtcagtaaagaatcattgggcttaacaacgataacaacatcatgattatttcgcgccgtcctgattttcagattacgggcgcggctggagttatcgataataatagcaacagattttttctcaccaacccaaccataaacgtcattcagcatgagtgaatccttggattcaatatacccggcatcccaatatatttcaaggtaataaggattcccggcagtacggaatggagcgtcaacatcgatgttacgttctatatcaggggtgccgttgtaaacatattccctttgtagaagcgggtatcagccgggaagtcccgctccatcattttgcggaaaccgctaccgaacatgttggtgaattcgtctttcttcatatacaacgccagcgggcctttgctggccgccaggttgagttcggaaatcttttcctgcataattttattcgccactttcttgaactggcgattcaaggtttcgcgagtgtactcatcgtaagacaagtcttcacgggatggcgggacattaagctcaccgagttcaaagaaggtataggacgtcgggaacttttccagaatagaagaaacgtcttgttccagttgttccagatcaatagggtatgacaccccgcccatgaccgcatagtgggtattccccgtccccttcggctggatataggtattccccacccggttgttaaaactgatgtcttcccaatcgaagttgtatgagtgattcgtgacttttgggcgctcgttggacttcataactttgccaaggcgaatcagctcttcttcaaacgcacggaaacgactgttcttgaccgggactttcacagacaaaccattccattcatctgtgtcttccggcgcaggttcgcgggtttctacgttttttgtcaccaggtcaacggtcgggatacggttcccgttcagatacatcaggaagcgatagatcttcccttcatagcgggattcaacagtgaatgaatccgacacagagaaaggtgatttggaacccagaccgaacgcgccgatctggccatcatcgtcttctttggtactgttgaacaaagtggtataaagcccaggggaacggatgatttcgccatcgttgggttttaaagaccaattggccaccataatacgaagagaaatcgggtacacccaggacttcagaaccttctgggatttcgtcttctttgacgaccatgttgcccgccagaagcacttcatcttcacgggccaaaataggttcacccatgatctgttccagcgaaaggccgataccccagtctttgatttccagccatggctcgtaatcgtccgggagatggacttctacgggaatgttagaaggagccagatacttactgtacagttggggcagtcggggacagagaggcataatgagacggcatccagcgctgtaaacggttacgcatgttgtgggcgtcaatcgcattacaaacggtctcacgaagcgccgccgcttctttataacgataaaggctggagaacaacgtttcaaataacttatcggtcattttgacgttgaacacattaccagatatagatgatgaagagcggacgaagtgctctgacttgcgcattttcataacgaagaagtcctatcagtttcaaagggattacacgaggggtatgatacgtggcgacagttcaattgaaaaagccccttatcaggggcgtttgattcacattattaaacgagtgatgctcggaagtcaaaggtcgggcgcgtccgcccccggttccagcacttcttccagataaccgacgtattgtttgacaactacagtcggctcggcacgattgggcttggttgcactcagatccagaaggctggaagtcacctgctctacaacagtgcgcttgatctcaaaatggtagcggctcccgaaggcggcgatctcgacttcattaattttgaagtcagacaattcactgctgttcaacgtaccgatattcaattgtgagcgcagatgctcaacaatgttagaataaatgtactgcggcgtgatcagctgttcaatagaactcataatatatcctctaaatttcgggttcaggtttacttaatcgagcgagttcggctcgaagatacagaatttcgtcggccatctgtttcccttcaccaaacatgacatgacacttcaccttcctcggctccccttcagatatttcgaggagccgttcttctgttaaggtgtcatcactcatttgcgtttccttttgttctttccatgcgttttggctttcttcggtcgtttcaccgatggtcgaccatggcctggttctccaggtacaccaccctgagtataacgacgccccacatatcatcccctcggtgtgacgcgatcgattccatttcggttaatgccagcatagcggcaattccggaagtagactttttcatttcgtatcccctttcgccgcataagacaatgccttgacgatcatcacagccaactgcatagaaccatagtcaaaatcacgttccaccgatgctctgatttcatcacgagattggacttctggacaatttttgctctgacggcgttcttcctgatcgattagatcgcgaagcatcagaccagtaaaagaatattcgtcaaagttttccagatattcctggatacccgatttcggtggattggtttgtttgacttctggtattttagactcagacgttttcatggaacttctgagtttatagatggtgctgctggcaacttctcgccctttgttcaaggcagtgaagtcgacattttggccccaagcgttcttcaccggatttgaacaacattgaccgaacaaatcagaccaaccatcatccagtgccaggagcgattgtaccaacgcctcataagttggttcatcagattggctcatttcattacattgggcaacgatattgtcaacgccccaaagaggattcaacaattccatcaatttatctgattgctctttagataattggatgccattaatcatagatttgatgaacttgtcatatgctttcacagtatcgacaagctgctggtaagtcggtttggtctgcgagttcattttctttttcctttgttgcgtgccttactggccaaacgttattttgtgctgccccgcgcagcggggaggcttttggtaacgagcatctttcatcatctgacgctcgtctcgggatgtttcaataaaatcattgtcatctaatttgcgccttgacttcaggctgttgacaagctgcttcacatcaaattcagaacagatttcatccagaatcacgatgcgcttgtcgttctcttcaccacgtgccaattcacgagctgacatatgatcttcgatcgaaatctgctttatttcccattccgggtgaagatcttgtaatgcggccttcatgataatactgtggtgaccgcccccgactgatcacgatctttttgggttctgacatgattttactccaaagaaaagggatagagcaataataccctatccctgtttattgaagaattaagtctattcagcttgcgtggagttcaaatcaccgcgcagatcctgaataggctggccgccaactgccatgatatagatggtgttgatggtttcgaaccaggtcagttcgttgacgccttcggtgtatggcgtcaccggaatagaagttttgtacttcgtttgtttctgtatccggatgtgtttcagccagggtaaggaaagcgcagcgcccagacggatggataataccttctttgaacatcacgatctttttgcgaggataagctgcttcccccaaacaaacggcaagatggtggatcatttctggccgggttaatagagtatcatccctgatgataccttgtttaacagctgagataacgatctcgtccagaatagcctgttgttggtgaagactcatagattcagtaagttttacgcccatgacattaccccttgaagttaatcggtgcctgaaccccagattcaaaagctgcctgggtacggctatcacttacaacctgacaggtcttttccagatctaggcgcgggaaaccaaacattccggccacgatattgcccgggaactgctggagccgggtctcatacagctggcacgcatcgagttttttggtctggctgatacggaattcatcacggcccgcgctgattacgatctggatttctttgtacagggacgaatcaaactggatattctgttcctggatccattgcatcaccgctttggaaccgtcggcgccatagcggccttcaaatgttcccttgatgacttccttcaacccgttcttgtacatgtccgggatttgcgccgtttcctgcactttcagagtataagaactcagatagttctccgagtccttgttgaacttcttaacattgttctccagcgtgttgaagccgttgaacgtgctgataagaaacccggcgatgattgcgatcaaaccaacggtagcaccgacgacgataagagaaggactgatactttttgtacattttttgtagcctcttgtttagaatgggaaacgacgatttagactaaaattatatggcccagcgccaagatagaataatacaccgaacggcacacaaccgagtaaagacacgatcagggcttcccaggtcttcaactcacgccatttcagataatccatctccttcatagacacccggttgtagcccttgctgatattggtagcgacttcttggaagactgctattctcatgggttgtccagtaagggataatccattgcgggaatgcaactccatgttgttcatgccatctgcaaaagatgtgctcttgccccaatttatcttcatgtctttggtgatatcggtaacgacgataacgtcattcttcttgccgcccgcccatgcatacaccagcccctggaaatattcaatcggctgacctgaagttatcacccaaacgatgttcacctgacgctcggcacccagagttttcagaacaccgttcaaataatcattccagtaatcgacaggaagattcaaaccagacatgttcagaacccggttgacacgatagtaatcatagacctttgggtacgccgggatgtaatctttgaacttctgggcaaattgttcatccgaacgggagaataatgaatccctgtttccaagaacgtagttctgatacggatgatcttgtgcagctggctccccgaccttcacctgtgcccagcgcggcggctgacgcaaaccttgtcggtctatgcgcttaatggtcagatcaccgacggtcgtttgaacatcccagtcaacgtcgtaatcatgctcgtcacaatagatcgggacacaggactggttgcctttactatccgttgaacatgtctgtccgcattgatactggtgctcacacgagaccttttcccgagtcttacccgtaacataaccattaaggatttccacgtcagcagcactccccaacggagaatgctgcgtatgcacccgcttgtatcaggcaagacaaaccaaccccgactaagggtcgtatagaccgtctccttaacgttgtggtcggcctggtgtctgacaatgaacgcgacggccatcgccaatggcaggatgaaaaagagatagatcataatacaccacccacgagttgggccttggtcatacccaacagttgttctttgtgtttttcatccgcgccgttggcaaccaagagcgcccaacgttcttcatggtacttcgggtccatggcttcatcaaacgacagatgataacggaacatgatggttgccactgaatggagaacgtgcgccgtagcccgctgtaacgttcttgggcacgtgatgggatattctgtatattcaacccccactgaggcgcaattcgcggataatgaacggtagtggtaattcacctttgtcatgcaattctttaaaacgggctttcgccgggtgtaactggccttcagtttctttcatgaacagatcgtacaggtattcagcgtattcgatgcgagtcataattttaatccttgaaataaaagggaacgggccaaatataagcccattccctttattgaagaaactagtattgctcagttatttctttatcagtgacatcagattaacactcttcccaacaggggcggtctcctgtttgcgttcaacgcgctcttcaggttcccaacgtgttcccttctgtagatgccagatgtggagtggaacgcccgtctcaaagaacaccggcatcttccacttctggacgcctgggacgtgccctgcgggagccttctcacataacagggtatccggtagccaaagtgaacgcgcttcccagagtgccgcgcaggagtattccggccaaatgcgttccatgtagtcgatttcatcccaggtacgctccgcatcccacccgatataacgagtgttcttcagacggaagaatttcttcaaccaacacgcgccagaggtctcaaagttcagacggttgatgaacgtcaggtgaccgaattcttcaacgcattcatggaatgccttttccaaatcggcttccaggatgtcgcactcttcatcggtaataggacagccgtcgatctttttctttcccgtgtttggtcacccaatcatcacggttagaaaggaacgccgcgccgttgcggttcgattcgctaccttcacggtcacgcagcatgaagccggggacatcgatttcccacatgttaccgaacaccatgttcagggcttccaggaagttccaggcgctcaggcggccgaagtatttccaggacatcgccgtgtcccacaactcagtaaactggtcttctttcatggtgcattccagcatccaacggaaagaatccatctgagttttaccgcccagccaatccacataggactgaacacatgggatcatcttggacttgcggtagcggcaatcagtatcgaagcgcatgcgttcaaagttcagattataccagtccgagaagcgctgcatttcttctttggtctgcggaggaaccgggaactcagagtagattgtccacgggccgatcgcattatagcagcaaccccaaaggaacgccatccagatcttgcgctcgatcttttccaggttggtgaggccttccgtgacttcaatagcataatccatcagacgcatctgctggttgtgctcttcagtataggacagcgcttctacccaagccttgagcagatacattcggttctcaggcttgcggtagtcaaccttcagatcaatcgggtacttccattgctcaggggctttatacccctgcggcattttagataaatgtgccatacatcaatccttttcgccgacggaacttgaaagttcttcatctccaggatgagg

SEQ ID NO: 700 - DNA, 7659 bp, Klebsiella bacteriophage F134/15
aacctgtagaattgatctaaaatttgccggcgccctggttgagtgagagatcgctgcccaaaccgggaggaatgggggaggtaaatcctcccccagaccaaagagtaaacagttcatattgtcgtgggtaatcctttaggccggactgatcaaacggtttatgggtcgctataggacaagagattccaaccctctgtcttggtattgtccacgacaatatgattaaaagattttggtcctgtagctcagtggttagagcagtcgactcataatcgattggtcattggttcaaaaccaatcaggatcaccatattacgctcggctttgcggcctgtctacacccggttgatctgggttttgcaagacccatactcaaccagtggattgggtgtcggtgaagcgtcctgactgatcattaggattgtgggggttcaactccttctccgggcatcaaatttgttggactgccaacaagctctggtctacggcaggcgagatgggatcgcgggattaaaataccgcctcgggagcacctaaataaaccagttgttcaataaacgattggtgagtatgatgaaaacgttcggtgagttcttaactgaatgggatggtcttgcgactgacaacaaagaaattgttgagtttgttgaaaagcgtggtgatcattgggttgtgttggatcataccaaaacaaaggttttgggaacacatgactccaaagaagatgctgagaagcaacttcgagccatagaagcgaataaataggaagattggcagagcggtattgcagcaccctgctaaggtgtacaaccgaaaggttagcacaggttcgaatcctgtatcttccgccatacaaaggaaagttggccgagcggtttaaggcaacggtcttgaaaatcgtcgggtgtaatgccccctgagttcgaatctcagactttccgccaaattgatgatggtgtagttcagtcggtagaacggcggtctgttaaatcgtatgtcgcaggttcaagtcctgccaccatcgccagacaatgggtgtgaaacgaaagcgagtaagcacgaagtacgcgaccgacaagttctttgtaacaacgtccaatagccgaacggaatctgaaaccgacgaaagtaacgcccaccaaatctggaacccggttgattagctgaggaaggatggccgatgtcctcaagcgtggcccagaaccgggttccggaccaaattgaagtggagtgtctcgaagcgccttcggaagtgcgaatcgcgcgatagctgccaatgtaaggttgcaggatacagacacccaggagagtgattcccacttcatacaaattcagagtgtagaggctacagtagtgcgcacctcacggaatgctacaccggacactctgatacaaacacagtaagcgttgcagccagctgtgtataaaatggggatgactccacatcggaaacgatgccccaactaccagaaatggtttggcgcgaagcctgtaaagttccaggagatcaaaccagaaggcactggtgccagttaaccaatcggcgttacgacgcggggagttgggctacggcagatcaaatgcacaatcgggtgagaagcccgtccaaattacaggagcatagccaagcggtaaggcaatgggctttgatcccatgatctcaggttcgaatcctggtgctccttccaaattatgggtgcgacttcctgcgggaacagtaaggtgtgcatgcccctgtttcttaatctggtgttgaggaagaataaaatacacagaaccgtaagtgaaatgcacatagctttctaagttctgatgactctgggttcgattcccggcgcactctcccaataatctgtgtagcacaactgcgaataggccatgtgattttggtctttatcaaagcccggtaaggataccgggtttctttttgtctataattctgattctcaaataggttaatctataaccgaatcgcgttataattcagtgtccaaccatgaactgaggaaatattgatgcgcaatgttactatctgggaattgaacgacgtggtcgttgacgttcctccattcgtccgtatgtacacatacaagggctacaagggaactctcaatgagttcttgtatccgaattttgttcaccgtgaagatcacatcgtcccgcgcaaccgcaacactccgggtaacgccatcccctgtaagttgttccagaaaggtatgactgtcatcgtcgggtactcttcactggattgtattgagaaaggcgacggtattcctatgctggtgttcaacacgtttgaacaagctgtgaactggatggttcgtaacaattacgactactatggtgaagagagttctcatgcccgccgccgtaaagtgaaagcagtcgatttcttcactgagcgccggaaatatattgagatcgcccgtgactatgaaaccatgttgcgtagtcgtgaagttccgctcccgccagcaccacctgtgcctccaccaactcgtgtcgtcaaagatgatgattctttgtcccgtcaattacgtcacgacagttctattccggttcctgaatctaaaaagatttcagccggacgtaaacggggtggctttttgtctgagatcctgaagttcctggatatcttcagaaagtaatcgagattctccttttctatactcctgtagatacgctatgatatgccaatgtctacaggagaaatagaatgaacgataaaacacagaaacttttaaatgacatcaaaactagttgttgaaacaaatacaactccatttacagtccaaagctgtgaaagtagtatcaaccaagatatccttgaagaatttgtcagcgatgcgttaaaggaagaatcgtcgatgggggtagttatctctcaacatcacaacaaaactatcttcaaaactctttctctagaccgcaacctggttcactgggaagattatctctacaaacacaccccgtgtgaacttgttgccaaccccgtaaccaaccaacaggtttggttcaaacgtgaagattacttcgcgccgctgtcccagtacgccaatggtaaacagggcatcaacggcagcaaactccgtcaggctatctggctcatggttgagcatttaaaggccggaggctcccccgatatcatccatggtactgtcgttggtagtccgcagtcccctatggcgacggcagtctctcggcacttcggcgggcatacgactacagtcctgggtgcaaccaagccaaccacttgcatgaaccatgacatggtagcaatgtcggcatggttcggtagcgtcttcaatttcgtcggttctggttataacagcaccattcagccgcgctgtaagaagctgattgaacaacagaatccaaaggcgtattatctggagtatgggatcactctggaccataaattgcattccccggaacgcatcgctggattccatatgctgggtggtgaacaggtcgccaacattccggatcatattactgatctgatcatcccggcgggttcatgcaactcttgcaccagtattctaaccgggctggcgatgcacccgaaaccgaatctgaaaaatagtgtatctgatcggcatcggtcctaatcgccttgacttcattgaaagtcgtctgcgcattattggtgaatatgctaatttaccacacatcgtggactttacccgccattatcatgacaacccggattatctgtatggtaagaaggacgctccgcagtcccctaagagcgtttcactgcttggcctgttaggtcgttacgacccgaaagaactggagagagcggatggttctccgcgctttaatgtccatcactgggatttgcacaccaccaattgggttcgttacaacgatctgatggaataccaatggggtgacattgaacttcatcctcgctatgaaggcaaggtcatgacgtggatccaggaacacaaaccagagttgttgaacgagaactctctgttctggatcgttggtagtaagccgtatgtagaaccgatgaaggcagcatgtccggagttgggtgatattcctggcagtgatcacatttttgtcgatacatttataccttcctaatttgtcttgcccatatggttctcagtgtggctaaataccccataatccacactgaggatcactgacatggcaatctccactttattcgaatctgagtcaatactggacgctccaatctggactggcgttcaagacggcacaaccatagtaattttttgagcgcggggaaactggcgccgaagagatctatgcgtccgtagaaggcaccgacgttgttcgtgctgctatcgccctggcaactttcctggaagacgctccgattgatggagttcctttcgaggcgcacgttgaccccgatgatccgaccagcatcatcattaccgttcagggcatggaatatacgtcgtacagcattgagcatgatgaagaaagcgacgcgctttatatcgccaccgacctgcagctggaagatgatgagattgcctatctgcaacagaatggtaaactgccggagtattcggatgaagatctggatactgaattggctgacgtcgatgatgacgatgatttctgggacgaataagaaaaggggcgaaagccccttctttgtgtagacctatgtttcaaatttgtagaagaagcccccggaaggggctttactggtattagaggcggctatccagccaggctatttttctcgttctgccattcccaagcggcctgaccacctgccatcagaatttccagaggaggggtattgtcgtcttctccgccgtggagatctggatcaaacccgtcatcttccggatcatcttcacattcgttctggtatgcggaatattcaatccaatgtgcttcggcgtccatatccatatcgcccagagcggcttcaatagtcattttgccttcggcaatcagttcggcagttgcatcgtccagcccggcgtctttggcttctacaaaacgctcatggcgcttctggaacaggaagaactgcatggcgtcaacgtaggagtcaaatttttgttttcatctcttggcgaacgcctttcatgataggatgatatacgaccatgtaacgcccagcagaaattttgtcgccttccacagcaccgaagaagttaccgaaaacgtgaccttcacctgcatcagacaaaactagtgtttttgttttgtcggtttctgctaaaattttcatgatgtatttccttcttttcagatagctgagtttattattgcgctctaatcggagcgcaaggtataaaatcagatttttgcaaagtggtaggtgccgttttcgccttcacacgcccaaacggatttaccgtcgaggccgctacgaacctgaatctggatgtccataccgatttcgcattttacgaagactttaccgttttctcggtgggcttcataagtgttaccgttgatgaaagcagcgtcgcctaacaggttgcttgcgtggatgcatttcatttttgctgtgtcggtcatggcgtatttccttctcttcagattgttgtttgttcgtactacaatttgaagtatacgccagttattgaagaagtaaagtttttcaataaacattttaataaattttgaactctgctcctcggtatgtcgcgaaccctcgttctatgagaccatctggaacaatcacatttgtgggccaaccaccatctggtgcttttactttcagtctagttttgtgtgagccgagtttagtttgttcataaatccggcctcttactatcgtcgccccgccctgggtgacgagcaatctcttgtttaccacatccattccttaacaccaaaagaaaggggccgaagccccttgaacattatttcttcagatcaggccacgcaccagaggtcgcagtagacccagctgggggagcagactcaagatcgggagaacccgactgagtaacaacagtgggatctttgctaaccactttgacgccgaattgtttaagggcatcgacagcttgcgccttgcggctgttgcttttaaagtggttgtagcctttgataccgaatgatgcactaattgctgtcaataatgaagcagtataccaatcaggcgcggtatccagggcttgcatgccaccgactactgctttgatgaaatcccctttatgatattcgccggggaacaaaagcagttccacaacaggagctaacataacgaggatcgcgggaaccgcaagaacgatagtccagaactcatccttccaagaaccaccaacttctgtgatcttagatagttcccagtcggaagacgatttgatcgcttctaacttgacatcgtgcttggcgcttacaatttcccgcttatattgaatcaaatcagttcccagattccagagctgtttcaaagcgccaggaatcatgcttaccaaggggattgccatataaactccttggtcaatgaaccctcctcggttaaattatgggaacgtgctaacggcacggataacctggagaatacaatgactgttttctatactaacgtcgcccggcaaggcaacgacctgttagttcgaattgcagatgacatgggcaaccgccgcatgctcaaaaagaaaattcgaacccactctatatttacccacggctgattattctaatgttgaaaaagtcggcctgttgaacgaacctctgatttctaaaaagtttgcgtctatgcgtgacgccgacaactatatggaggaatacaaggatgtagaaggcgcggcgatatatggtcagaccgactatgcctatcaattcatcgcccacagttttcctggtacaattcagccagattacaacaacatccatatcgccaaccttgatatcgaagtgttctctgcaggatgggtcgatgggcagatgactaaaggtccattcccgcacccgacgatagaactacagacgttcaaagggagcgcggcgcgtgtccgtcagttccataaacgtatcttggccaaccatgcgttcgtccgcgagcatttccccggctcctttatctccaacaacgtgaccgaccagttccccatcattgacgccaatggtaagattactcagaatatgaatgcggcattcccgattacgctcattcagctccaggatctgaccaataacaaatatatggtctgggggatgccgtgttctaaggatcgccataaattcaaatatgacccaaatgatgaagagatcggtggtctggaagtagaatatcaagagttcactaccgaacaagatctgctgcggtcatttgttgattactgggaagcgcgggcctttgactgctggacaggctggaacatcgagcaatttgatacgcccctacctggtggaacgctgcatgcaagtattgggtgaagccgacaccaatcgcctgagtccttggggtaagatcaaaaagcgtatcatccgggataagaagggcgacatcacgacttatcagttcgttggctgtcctatgttggattacctgcaggtctacaagaagcacacgtacaccacacgtgagagatattctttggactggattgcgtattgcgaactcggtgagaagaagatggattacagtgagagcaaatcactgtttgatctgtatttcaacgattattgtaagca

SEQ ID NO: 701 - DNA, 7650 bp, Klebsiella bacteriophage F134/15
tagcgcaagaccgctgaagagaacctgggtgaagctgatatgcgtgaaaccgacgctgaaagatggccatctctcgtggtgtgaatcctaatcgggcgggatgctctgattatcttacaccgccgccgcatcggtgaagccctgttggtaaaagttactgatatcgaaaacagtaacaaagaactgaataaggccatcatccaactgggcgataaatttgatgaaatcaaatccagcctggaactcgtccgtattcagaaagagactaatgaactcggattgtcactcccggaagacgttgattatgccgctggcatggttaatattgacgttgacgcaattttgcgtgaagctgaaatttccgatccgaagtattcggtcaacagtccatcgaccattgaagccgacaattatctcgccagtctgatcaaatagtaaattgaggggttatacccctcaatccattagggggagtttatgatcatcattgatgggaacgatattatatgggggttggcagttttatctctcgtattcgcagcttttcaatttttctaaaggtgttcaaatggagaaaggtgaaaagaaggccaaagtttgttggggatacgctgacctgcccagtctgaaagacgctttgatggcgcgtaagagaaaggatgacgattattttcaccggacggactttagtttggatgcacggcacccagatacatctgccgttgaatacttctattatacgatggacggtttgaggtggcctataataggggatattacgtttttaaaaaagaatgtatttcttgtagggtatatcccacagacggtgattggatccgggtttggtttttctaattttagtgaagaacttgaattcaaccaaaaaattattcgatctttttaaagaatatgaagaatctggttgtaaaccagcgcatagtgacgaacctatagaatccatcatacgccgtgcccgtggaaaagaattaaatgaattggaaaaatacggcttttcctggggggacgaattatgccaatgatcgcctatttcgtgctgtatatggtatatgcggcaggatttttgtatatggtgctgaacactgatgttatctgggagtttatccataaacagtatatgaaaatcaaaactcgctatactggagtggttatcgattcgatcatcaaacaagctcgatcccgcacccgccaataatttattgaagtctttggggttataattggataacaaataaccccggagactcaagatgattcctctgttagaagcaattcacactcttcgtgagaccaaaggcaccaatgccaagaaagaagtcctgacacaaattttgaaagaaaatccggacatggtcgattttcttcagtatgtgtatgacccacttctttcttattatcgtacaaagtttttaccgaatgcgttccctcgtatgctttcgcgcggcgtcgtcggtagctgggatcaggtgtacgatgttctcgaccagatgagcgaacgtaccctcagcgggcagaaagccgatcatgaattatcgaaagcggcgaccaatattcacccggattaccacgaactcatccagatgatcctggacagggacattaaagccggtattgctgaaaagggcatcaatgcggcattcaacgcagcgggcgggaccgggcggctgatcaacgtacttccctatcatcgttatgacaacatgacgattgacctgctgaagaagatggacttccggcgcggggtttacagtcagctgaaatcagacggcatgtttgccaacatcatctgccgatacggaaaagaacccgaaattcgttcccgctctggttctcttattgctggcggctcagtggacaacctatccctggtgtttaaggatatcatctatgatgctggagttggcgagagcgtgttccacggggaactcttggtagtagacctcaaacaaaatgccatcctgcctcgtgctgtcggcaacggtaaactcaacagcgtgatccagacgggggaacctttaccggaacaattccaggttatctaccgggtatgggatatcgttccgtatagaaaaatggttcaatgccgagcgtgttgatatcccatatgaagcccgttacaacatcatctcccaaatgtttgacgatgatggcctggtgcaagtccaggaaacccgtgttgttcattcgtttgcagaagcggtcgagcatttcaaagacgcgctatcccgtaaagaagaaggcacgatctgtaaggcagcagatatgccttgggaagatggtacgagcagccaaggtctcaaactcaaaatggaaattgagtgtgatctggagattatcggatttaatcctgctgacgccaaaggcaagcattccaagacgtttgggtcgctactttgtaagacctccgatagtttactcatcgttggcgtctcggggatatcagatgatctcaggaagtatatgtgggaacaccaagacgagttcctgggtaagatcgccgccgtgctctccaatggcgtacaggacaagactgatgatgcgttgaaatcactcttcctgccacgcctggtggaagttcgtattgacaagaaagttgctaatacgctggctgaagtctatgagattacaaaaagcgtatgttagaaaacattctggttctattagaggccgcataaaatggatacgctattcaccctgatgtgtacaatgactttcgcgctgtccctggttatcagctcgttgtgtgccctgctggtgtggatagcgttccctgacgttgccaaatataaaatcttcatgtttttagccattattatcatgtagttttattttaacaattcactatgccaagcaggattataatcctgacaaacgttattcttcattggcggagagatatcatggcttcgaatttaaagacattaccagaaaatgattctgaatatttgcgtcgagttgttttggaattgggcgtgaactatagcggaatggccagattattagattgttcgaacgcagtcggattctggaagaaaggctatcgtcggatacccaaagcattccgccgggcgatcttgatgctgaaatttatcaatcaaaaaggactcatgtctgagttcttgagatatgtgggtgaacaggagaaacaaaatgccgaaattaccaaagaccgctaagaaaaatccaacggtatctatagagcgtttggggtggattcattataataccgtgcagttcatacatgataatggcctcggtgaaaagtatcgtgaattcatggaatccaaggcgcttacatttaaacaatcccgtattcggaggaaacaaaatggtaactgaatgggaaaagatggaatatgaacgggcatttaacgtttattgtatctttatggccatcaaactccatttcacgaccaaggactatgattacggcctgtatggcccgatgagcaattacaaattcgaaacattctttgccaaagaaggtatgcggaaacagtttgctcgattggcccggcggtttgagacttctcaaggagaagttgttgagaattatatcattgcaaatttcataaacgtcccccaagacctgggtgaccacattgttgactcggcaggcacaagagaattataacgaataccggaagctgtatgacaacttcacataccacttccttgtacttttttagaaaagaatatgattccagaaattgccggacgcggtctcacgttcttggattatcttaaaggcgacgggacaaaatcatccggcactattgaccgacatcatcatagaaaaaatatccgatttggtttctggtcgggctgaacaaaataaccgggttcatcgcattttacgataaattgttgaaagaagacatttattggaattcagaagcgttcttgctaaagaagactgatgcggtagtacccaacgagaatacagattacgaccaaaaataaattccgtgagatgatcctttcccacggaatttgatgttaccaatcccagagaagacgagtcttgtcagtctggttggaaggttccagattggtgctgttgaagttgttcgtcgtgctgactttcttagagttgtcaacattctgttggatcggagcgattacagaagcgggtggctggctgtacacagactggatttgtccgatgttatccgccgcccgtccctgtgtcggtttcgctacaccaaggcttccaccaccgatagacccatatgcttctttcaactgagaggtcttgtccgtgacgttctcagcatctgacgttactcccgaaggaataggcgtcagcgtctgtgcatcctggttagggagtaccggagccgtcgtctgatcctgtttgacttcaggctctgcaggctgttgtttctgctggtcagattgtggtacaggactattggtcggctcttccgtcccgatcatcatagcctgacgagcttcatccattttcttcctagcagcttcgccgcccagagcatcagggataatgcttacaaatttgtcaacgatatcgaacatggcattggttattgcgttcaacatgttgaagaatggctttttcacattctcagcaaaccctttcttgatgctatccagcgttttactcgcggctgcaatcccgtcatcaatgaatgaactgatcccgccagtgacccaatcaaccaacttgatgagttcactctggagattatcagccaacttaccagggatatcagtgagagaggtgttcttggtgatcccggcgaacagatcgttggatatccagttgacgatggagttaagccactcagcgggcttctcagagatccagagagtgaactggcggaacttcttgcccatgtcagtatcaaacccaaagatcttggatacccaatcgaacaaatccccaaagctgccgaccaattcggtaatacccgcccggacccggtctacaatggttacggatgctttccctaaaatctctttggcgttgatgaaccctttaccgaattcaaatacagaagagattaatgccagcggaccgacctttaagaatttcaaaactttaccgaacggacccaggagcttaacaatcccttccccaatcttggagaacataccaatgaatgcgcccacggcccaaccgatagccttgaacggtttcaggaggaaccctttgagggcgttgaggcctaacatagcggctatggcagcacctatccctgatgagttctcgtctttctggtcatcatcttttgggatgatggaagtcgcccgtggattgttcttaccttctttcccttcctcgccccggcgcatttcttccttttcacgccatttctcgttgctgtacaaaaatacggacaagagcattaacaatatgaccaccagtctttcctattttcttctcaatggaagataaccggatcagttgttctgaagagttcttgtcgataccttctgtattccatctgacttcatccagagtgtcgccaatacgactcaaatctgaactgatgccgacaagagttccttcctgattgtccaaccgcttgaggctgtcatcattggctgctttcaactgatctgatatcaggttcaaatattcagtattggtatcatcagcgggctggcggataaggtccccaagacggtcaaccttctcgccgattttcatcaactcttcgttaccatcaacagcaacatcaacggtatctttcatccaaataccatagtctcgagtgaatatcggactcactcgagcgaagccattgacgaagtcgttgaccgaaggaattttgaactggaattctggaacatctttctgcttttcagcagtctgtagtttctccagatttttgttcatcttcaccagctgcttgttggtctcattttgagcgcggagttgtttcctctccatgatctctttcttgatcttgtcaagaacttgagcaacttcagtctgtgatgtttgtgctggctcagccatggctcacctcttacaccttctgtgattgtcctttgtcaacagggactggcgtcggttgagatgcaacagcctgatttgtctgaggaggcagaaccttctcaatcatactgtctttagcgatctcagcaacacattgataatcgttagtcaggcgtgaaattttatgacgaattttcgttatgatataatggcctgatgataacttacttaactcggccaggttttcattttgtttcggcctgtttgatagatcttcgatataatacacctgaccaacattcagacgattgtcaccaaccaaaagcaaacgcatgaccgtagatgccagactgaatttgatgactacgttttgcataatccacctgctcggcaccgtcgggttgtgcttcgagataacggacgttctcacgattaaattcgtcagagaataaagggtatggatccagatgcgctgtttcagcaaaccattcggtgtacacacgagaagtaggcgtaaccgttttggttctgaaatcatacaccctttcgtctacagccaggacatcatgataattcgccatgaattggtcacgagccaatttcttttccgctttgattatcgtcctcatgaaacgctcagagttgaagttgttgttttgcagcaacggggcgtcctggggatcacggaagaatttcttttcaagagcggcttcttgtttttcttcagcggtcatagtctgattaccttggttgaacaaagtagtcagacttttgaaatgatatcctgtgaaatcttcatagaaaacaaatggcatgaatatctcatcataagaccgccgggccatgtaatcaatgctcttgagtacaggccaaagcggtgtcgcgaatcgttcttggataccataagttggatctatgtcttcaaatttagtgcgcgattcgagcatttcaaatatctttgccgccatatcggaatatgatccttggagaccaaccgatttacgcagcatgctatctttatatgcatcagtagtgaccaggtgcagccagaacgctttcttggctgaagaatttgactcatcagcaacacgcccaacccggctgacccggaacgataatgcggtgtaatatgtagccgccggggatttgaatgaaatcacgacttcttctccaccaaggataggcatcgtgtccagaatatcccagccttctttgatcaacacattggctgtcaatgatggtgaaacattctcttccaaacccaaatcttgatagatattgaattcttggaataatgaagtcagatcatatggcgttggggttcctccttccggtgtatgaggaaggatggccatatatttcaaatcaaacgtcgtggacggggttaaaataccgtcttgtgactctttgttctcaatcatttactcagctcctgttccagctggctgacaaacatggaaacataatcaggatcaaggacttgaattgcacgtttcgccttggtttttgttgatggcatcatcgtggtatgatatcccggtcaaaccataatttgcaatgatttgggagtcatccataccgtccagaccgtaagccatacggatagctctggcatctgtttcatgcccaaactgatctacatagtatttgatactcccacataccat

SEQ ID NO: 702 - DNA, 6908 bp, Klebsiella bacteriophage F134/15
cacatggactggtgaagcccgtggctgggttattacgtcaggcgtcggtctggggcaaggccgggtttacagccgcgaaatttacagccaaattctgtcagcgacaacaccatctattaccctgagcactcaaccatctattgtagatgtgtacgttgacggaaaacgtttgaaagaatccctgtatactctcgacgggtatgaagtcaaattcgatccggtgttggcctctggttctgatgtgcagattattcagtacatcccaattcagctcggcgcgggcggcgggggttctggtggcactgtgatcacctgggaatacaacggcggctcagctatcggcggcgaaacccaaatcgtgttggatgtggtcgtggactcagtatctgagatctacatccgtggttcccgtcaacagatagggcgtgggttcacatttgatcctgccaccagtacgattaccttggcggatgaactggatgccggggatgacgttgtcgtcgttatcaacggtgaccccacggtttacaaccaaatcgatcgttccccacaagaagtggcgcgggccaacaacgtacaaaaactctgaagtcatcctcagcactgagacgaatactagttttagacggtaagaacattgtttatgacgtggtggctcaaacaagttggagaattccaacagggataccggctggtgcgaaaataaaccgtgttatcgggaatattttagtgtatacgccaggcaacgttagcgtaaatctcatagaaattccttcggcttattctactaaaatctcaattaggttctgactacgggtctatttttgctcaatgaccaaaaagaaaacctttgggtgaagctgtacttgcagtatctactgcaggtctgttgtacagttcctcctgggttagtattatggaatatgctcatctggttactaatcgtccagatccaaacgatcagaccacttgggtttgggatcccgcgatacaagcatatttagacgatacagggattttgattaatcaaacacctgttaactccaatatgaaagctaaattcccgttggtgttcccgccgggtgtgttcaaaatcgaaaatagctatttgttggaacggatagcaggcagtacagggagccttgctactatctttatgttcatcggttcagggatgacatcgactatcattcaaccgatgacagaagggcagatagcattcactgtacaagattgtaaaatcaatttcagagacattggtttccgttctggggctgattaccagacatgtttggtcttgggaaataaaactttgtggaaaccagttttccattgtaatatgactcgagtgggagcgtctggatttggtaagggtctggtgatttacctcgcattcgattctacctttgaggatatatttgtacagaatatatctaaaatggatgttactggtactcaagtttcctatggtataaccatagaaaaataatgagggtcctgctaatggcgggactgctggtgacggaaccggtgatgattctaaccaattggtgtttattcgtcctactgttgaaactgcgaaagcagacaattctatacttttcaacgtagcaggccgttcaacttcattaccgcaccatgccattaatttgtttggcggccatttcgaaacgcataacttaaaagctaagttgctgaatcttgcatttggctataatgtcaacatgttcggcacagttttttcacaaaacgggcctactatcgattctgacaataacccgataacaacggtttaccggggtgtttacatcgagaactctcagaacgtcaatatgtttggttgccggattggcactaccaacagactggcttctgttggagtttctgataccaagtttatcaaaatcacgggtacttcacagaacgtgaatttgataaacacccatttgatcgggccttataatgacatatcttctgagcgtcataatattgacaacattatagattattcggaagcaacaaaagggataaaatcatttacggtacagggcgtcaccgccggggattataccagccgcccgataaccaaagacataagaatcagcagtatagacgggaagaaagaatattctttctatactgataattccgggggtttgcatttatcgtattctacaaatatagcggattcaagtacgcctacagatttgatgacgatggatacaagtggcaatatcctgacggcagcggacttgactctaggaggattggcagggactgcagctaccagacgactgtcaggtaatggcggctatatcgcctttgatacaattggtcgtgtgtatttcaacgctgtaagcaactcccaacaatgggtgatgggttcgacagcatttaacccgacgaccgataacacattcactttggggcaatcagggtttaggatatctgccagttttgttgtgaagcgccaatatactgcgacagtatatgattccgctggtaatggtagcccagaaggggttgtaactgctggtgttgggtcaacttatcgtcggttggacggaacggcaggtacttgtttctatgtgaaagaatctggaaccggtaataccggttgggtggcgaaataatgaaaatgaaagttattcgggatagttccggtaaagttatcaatatcggtgattgggattatatggaagagacgattgaagatccgacgactggtgaaatccatatcgtttctcataatcctatcccagaagggtcaactgaagatgaagaagaaatttcacaatcagaagacggcggtttatacgtaatgtaatatttcaactaaataccccatattggtaacgccttatggggtattttcaaatgaccagaaacatagaagaaattttcggtggggtagtcgtagcaccacaccagatcccgttcacatacacttcaaccaacggtggagaaactttcctttccctgccattttatcctatcaccgggtttgtcacgattaacagcggcgttcaggttccaattgaaaactttgaacttgacgggaatacactgaatcttgggcgagagctagatccaggtgatgttgtattctgtcttttcgataaaatcatgtctcctcaggatgcgagcaataatgcaattcgtatctacaaattcctttctggtcgggggagaaacagaatttactcctgatttcacggcgtatggtgtccagtctttgtacatagacggaaaatacaaaacgcccggtgaagattataactatttcaaaacttccaacaaagttgttcttgacaacggattggctgcgggagtttgggtagttgctgagatgaacataaagcagaatattcctgctttagctggaaatgatggcgcttcacagattggcacattatctggtaaaacagttcaagaagaaataaatgaaatacccaccgaaataaatgatgctgtcgatggtatctaccagagattgcaattacatcaattacctgaatcaggcgcgatgaaaatcgggttaacgactggagaaactgttgaagaagccattgcttctcttaaacgaagaactatgtcgattatgcccgaagacttcgtgaatctttctaccgacacagaaaaacttttggccgcggtcgcttatgctaaagctaacaatattgaaacagttttgttgatgcctgggaaaacttatactttcactggaactcaagggttagacatagatttggggtatttttcttttgtatgccctttcggcagatcatacattgatttctcaaattttactggcccatattgtttgtgggcgcattctagccaatcttacccttatggggcaaggaatcattgccacactatgaagggtgttcatgccaaagcagctattcaaggtataaaccaggcattgctgttattgggtaacaacaataacagcagtaatggaacatacaatggagattgtaaaattgaaagttgtttgttctctacagccgacattgttgttatgggttcagcaagtacctggcgatataaattcttagaatgtgggtttatgatggagaccgcaggtacatatgcaatgtattttcctgctggtatttctgattccggggagtctattactttccaaaattgtaaaatttttgacatgaaacgttgcccgatattgttggcatgtaacaattttgcaattggtatgcccggcacttctgttctcaataccccgatacaaataactggtgccggtgctatgatagtattggattcagctgctaatatagaaaatccgggtgctacaacttggtatcgttatgctgaagtaacaggagtcgctgctcgactaatattgaatggggccacattggtttgtaatggaccttcaaatcaaaccaagccattgttctatgttggaacgaatgcctttattgatttttcacatgtaaaaactcctggcaacgcatatcaattctattctggcgatgagggatacaacacgttcgtggaaggtcctgggtttgttattgcaaattcctgcattgctgatatcgcttctggtgctgggaatataccattacacaaatctttaaatccgattggaaattatgcttttgcttccggtgatatcaatagttggagctttaacaaccaagggtcgccaagtcagactgtcgtagttgcacctgaatacgggttttcaggttacggtgcccgaatgacatcattcgggagtttaagttgttatttgacacagaacgccaaagtcacgaataacaactattttacaactactatcaaactcagaactgtacaagctggaacgagttctgttggggcaggagcgttgagtattaatttctatgatcgtaatggggtttcagtacaggcaagcagcatagcgacaataagcaatacggttggttcatgggtaagtatcggtaactttatccaaggcagagtcccacaaagtgctgaatatgctgaagtttcaatacgttgtagggaaggtgctatcatagacgtggatagcgtgatcataaattttagttgagaaacctatatgaaatttatagttgacatatggtttgtaagtgaagaagacaatttaccaatctctaaagaatatgaattgtcagaagaaattaagcacagaagacctaaatgacagaattttagatttaatatttttggtatgaagattttaaggaaaaagaaaacataacgttcaaggtgagagactctctgcactaaaagaaagcccctttcggggcttttcttttgaacaaactaaatagagtagtatatccagaaaaacaacaggagattcatcatgaatccgcaatttagtcaggccggtggttccgtctctaaagacgtgaacaaacaatctatcgcacgttcacttggggtgaaagtcggtgacgtcgtttatcttaaacaaggtataactctacaagattataaggcatattttgataaatcttcacaacttgtatttttgtaaaacaccagacgttacggggactctggtgagttggagtgtggacgttgcttctttgactttgactttgaccacatctaataatgtttacaatttgtttatagccccaaattcgttgactaccaagaaaactcttacttttgatatgttttatattgataaatctggcaacactgatgtcacatctaaaataaaatctgtgtttgatatagcgaataaattcaaattacctgtcacacaaaatgatggtctataccttatatcaggttctttcactattatttgtaattatggatttaatctctctggttgtactttgaagttagcatctaatacgacagggcaatttaaaatttactcaaccagctggcccaaccacgtattccgctggttctcccctcgttgaacatgattaatgctgcttctgagacagacttgattgctgggaatggtctgttaacttctttgaagaatgacactactctcaacaacactttttgtttctttacgggagtggatgatctattccaatacactggtaacgcatccccttcaaaatggaaacataactgcgctgtttatcattatggtttgctggctatcccattcaaatacggggtttccgcattagaatccatatattctttgcctatagcgaaacaagtgacggaagtgcacttgcctaatgtggatcttcagaataacccacataatatattattcgcatttgatgggataaccagatatcgtattcacgaaggcggcactgttaacaaaccgttgaaacaagtaggaccattttacctttgtagtcttacaaattatatgtatgttgaacaatacgcactttctgatccgtacccgactgcgtcgttcagcgatgttaacatgacacaacaaacggcttcctatacgttgaactatggtcgtgggagtgatttaacggtatacaattcaaattgtcaaggatatgggtggggcgctacgggtggtggtgacatcatagctaataccacattcattaattgtaactttaaccggtatgacagccataatccagtcattggatatttcaaaattattgattccacattcggcgtcgggggtgtagcggttgctggttggggtgacgttcacttagaacgacctgtttggaatatgaatccaagagttaatgatccatatggtagcaatacccctatgttcattcgtatccgagaaacccatggcggatggtatgatggtgatctttatattaaagacgctgtaataaacggatggacagataccgcgcctaatttcatagatgctaccccaaaactctgacacttctttacccgctggttcgccaataagcccatatgcgtttaggaatgtctatgtagat

SEQ ID NO: 703 - DNA, 6860 bp, Klebsiella bacteriophage F134/15
gagtacattcattgtacaggagaaaggagaagaattcatccgattcaaacccgttatagcatcggatgtgtctgaattcggccttttccgcaaagccgattatcacgtacatatgtctgcaaccatatgtggaattgatgcgtatgctcgctcattgggtattcgtcctgggcagtaccataaaatacagatagggaacccgatcccgattgagaatcgcaaagtcaattacatgccggttatgaaaatgaccaacaatatgggtgactatgagatgcgtcagctggccgggtttgttgacgagattatccaattccaccaagggcaatccggcatcatccatacagtgagttacgaccgggcgctggcgatacagaagttcagcaaataccggaacatcattcacgtgcctaggacccgcaaggctctgatggaactgatggataacgctttccgtacgaagacgccgtgtatcattgccagcccggctatggaagaaggatatgacttcaaaggggattatagtcgtttccagattcttatcaaggtgccatatgattaccttggtgacccattagttgcgcatatcaactctgtggacccatcggcgtatttccggaatgccatactgcgtatcatacaaatgtgtgggcgttcggtcaggggcgtgaacgactgggccgcgacatacatcctggattcttcttttgaatccttgatgatgcgcaacccagagttctttccaacttggtttaccgaggcagtatttgaagtttaataaccagcaataaatgacaggcgacatttgagattcggtgccagggatgtcagggatatgatcatatcatcgctgtccatactgtactcaattgtcgccagttgctgggtttgaacattgttgtattcactgtagatcaagtcctcaccacggaaaccgatttttccatctgtatcttgccaatgaccttgtgttttgtcatacacatggacacggaattctaccatatggaaaagcgctttcggtatacttttcaatatactggtgccgacgactgggatctcaatattggcatcattggccccgccttcataaactggcgtccaattgaatataggatcaccaccagcgaccggagtccttttccaatattggaattccgggttccctgaattcgtttttctgcaacaatatgacttcgccacctgtaaaattggtggtgtcaatatcgtctcttgctaaaatatccgccggggagccgataaatttccagccatcacgatccaataatgacttataatagtctgtgaaaacgttgctgtcgccagcattgttgattgcgtctttgagaccttctcctgtgaccatctcattgactttcaaccacatgtttttgaccgcagacgctgccgcaacctggcctggtgtaccgcctgcagtgtagtcatagatgatgtctacattctgtattgcggtctgtatggacaggagaagtcgttcgatttcagctgcggttaaactgaaacgataagaacgttcagccataataatgtcctcatgataaacaagtttggagtatttatatcgtgattgaaatttacactgacggcgcttcatcgccacagaccacacaagcggcgggatgggcctttgcagtcagcccgatttctggcggggtacaatggaatgtattctatggttatttgccgccgccttctacgaataatatagcagaactcttgggcgttattaatgctctgaaactcctttggaaattttcgggttgtggtgagcgtaatattcccaaagcgacgattatatctgacagccagtatgtcatcaatagtgccaccaaatggcgttcgaaatgggaatatgagggcatgcctcccaagaatactgaattgcttcttgatttgttcaatatgtatgacaaagtttgttcaatttgtgaacttgaactaaaatgggtcaaaggtcatgcgggtacaatcggcaacgaaattgcggatcagtggagtgtccgggcaaagaaaatagcagtatggtcctggaaaatgaacgatttcgcgtcaagaaagtcgtcggttcattcaatcaatttatcggtatctctgagggttagatcatgggcatgaatttcgtagacagaggggaaaacgtcaccaaatatttcactgacgaagacaatgagcgtgtcatcgcaatattacgtgactggatacccggaaggaaaaaggcgatagccgaagggaagcccctacccaagatcccgaattatgtggccgccaaagttcatatgatcatccagaaaatgagtacccgctacaactacagagattatcctttccgtgaagatatggtgagcgatgccgtcgccaatattcttcgatatttacacaccttcgacgtcagccatgtcggcaagaaagggaagatcaatttcttctcttgggtcaccatgtgtgctgatcgttcattcgcccgcaaactgacaatcgaagaagaacacacatatatcaaattgcgttcgttcgaagacgcgggcggatttgccgcgttcagtgatgatccagacttccagactcagacatttgttgacaacactgggattacaatggattttcgtgagcgcataggccacttcgaaaataagaaagaatcccagcgtgaaaaggaaagacaaaaacaagccgacctcaaagaagaacgaaaagaataaaaagattaccaaaaggtatacttcaatgtctccgtggaccacaaaataatgctaccgcacaggccgaagatgattcagaacaagacttcggacaaaacccaattcagccttgaagaaataatggatagccctacgctgctatccgaattatcaggagaaaagaataatggcgattgctaagatcggcgatttacacatcgggagccgcaatggctctcgttatgttcgtgacttcattaagaattacctcatcaactatttcattcctgaactcgttgatgccgatatcaaagaagtctggcaattcggtgacacatttgacgtccgtaaattcatgtatgggcgcgacaaagattggctaaaagatgagttggtcccggcgctgcgttctgctggtatcaagtggaacggtcttgtcggcaaccatgacatcactctggaagagtccaaccgcatcaactggccttcttaccttgtcgatatggccccggatgtattcacttattactccgaaccgacggaagttatggtcgagggcaaaaaagttactggtgctcccgtggatcaacaaagagaattatgcgcggtcggtacagatgttgcaagacactgatgcagagttctgctttgcacacctggaactggctggtttcaaaatgtatcagtcctccacttgtgaccatggccagatcgatttgtctctgttgagtaagttcactcgtgtagacacaggacactttcacacccgttcgtttgaagggaatgttcagtatctgggaacgccgtatcatctgacatgggaagaccacaaagacggggataaccgtggattctacgtggacgacctgacagaaggtggtgagctgttcatccccaacaacaccagccaaactctattccggtatgtggaatatgattacaccaaactttcatctgatgacgaaggtaattggattgatccggaatggctaaacaccaagttgggtattgaaggacagatcgttaagattatcgtatccaatcgcgataattctaaacattacgagaagttctgtgatgcgatgaagcgctgtaaatgtattgactacaacttcatcgataagaccgtgactgtttcggctgaaaaggttgaagtcaccgaagaaatgatcgcgaccgatgccgtggaagttctgaagaatgatatccgcgctgctgacaatatccagcgcccagaatcggtctgtaaactggccgaagcattctatacagccgcccaacaacgtcttaatactctggatgcataacgatgacagatattcttgaaaaatttggcaacctgttaaaagaagctgcgacgccggaagatatcccggttccatttgatgtgcgtggtgatgttacccacaaactcaccttccgtaaggggcgggcgaagaacttccgttctattggtaatgaattcatggaaattgattaccagcgaaacccagcaaccctcgtcacatctgatgataatggcgccgggaaatccactatgttggtctggctgttattctttgtcctgtacaacgatacatacagcaagaaagagaagaaggccgggctggtaaattctcagaacaaaaaggactgcgttggtgaagtagaattcgcctgccggggtagtgaatggaaagtccgccggggtatcaaacccgacttcgttgaagttcatcagatggtagatggtgaatggaaacaggttgtaaacgaagcggctaaagccgacatgaacaagtatatcgtcaacctgatcggcatcgaccagaagatgtttgagaactccctggtgttgggtaaagagaaattcatcccgttcacggaaatgtatacggctgaccgccgtaccatggtggaagcgatatgggatctcggcttcttcagcctgatgaacgaagacgtcaaggcaaagatcaaagtgctcaacaaaacgttggaagatatctccaatgagtttggtatgaaaatgatcgaccataccaacaaaaagaacgcagctggcacagatcattgaatccaataaccgcatccaacaacagtctgccgaaatcctggagcaggaacggatccggctttccagtctggatgcggatatttcttcttaccaagatgaaatggcccggttacaggaagtcgaagtcaacaccaaaaaggaaattggtgaagtagaaagtcgtctcaatcaagaatctactgaagagatagaaaacctaaaggcacaatatgccgagaagatgaaagcagtagatgacattgcatcagataaagctgaggactatgagcgtatagaattgtcttcggctgagcaggcgcttaacaatatccgagaccaagcccgtaaggtcactgaacgcaaaaacgaagtactcaaccagcgcaatgagaatctgaatgttctcaacgaagcgatggaaaggctgcgttatggcgaaggtttcaggatcaaattccaaaccgaaaaagaaagggtatcaggaatccattcagaagttccatgatatgggtacttgcccaacttgccaacaagaagtatctgaagaagctaaatcccaggtccaatacgaaggcaacatcaaaattaaagacgtagattcccgtattgaacgactggaaactatgctggaagaaatcaataccaccatagcagagcacaaagcgaaggatgatgaatttgttcgccaagtcgctgaaatcgatgctgagttaagttctctgcgagaccaagcgacagaagcgcataatggtattgaaacgattaaacgggatattcaggagttctacaaaactgctgaaattgagaaggcttctcttgaccgtgaactcaaatctcaaatcctgtctaaccgccaggcactgaacaccaggttcgatgacattacggcatcattacaacaaacgttagagacagcctctcaggggcgcgcaactgtcaaggataagatcggcgagctgaaagcccgtcgtgcccctctcgttgcttcgattgccgatttggagcgtaaactatccgtacagccgactccaacagccgacctggaagcagtcattgtaggtattgaacaatctctgaaagatctggaagaacgacgccaaacgacagatgaagaacttcaggatcataatcatcttctccatttcttgaaggatgaccagaccaaggcccgcattatctccttgtacctgccattcttgaataagaagatcaacgaatatctggaagggatgaatatgttcttggacatttctgtggacgatacgtttgatatcaccatgggaaccgccgggcgtaaagggcaaagtctcttcagcttatcttccggccagcgcgtccgtgttaacattgccatcaccatggctctgcgtgacgtcgctaacctgaaagcatctgtccaatgtaacatactggtgtttgacgaagtgctggagaacctttctgagcgcggtgtacaagaatgcattgagatgctgaaatacaaattcagcaataataatctcttcgtcatcagtcaacgtgagcaggaattccaggaatacttttctcataacattcgttatgggctgcgaaatggtatgacccaggtgatcagcaaggaatgatcatgaaagtcgtccatttcaagaaggaaccatatgacatctacatcgggagacccggaaaatgggggaacccgtttgaggtcaaatatcatgggcgcggtaattgcatcgaattatttgaagatgatctttaccgacgcttgataaatggagatatcacggaagatgaactccttgaattggacggaaaggccttagggtgttggtgtaagccgcgcccttgccacggcgatgtttatgtcaaagtggtcaaccgtattaaactattccgattgatgggtaaatcctttgtagagcacttgagacaaacatatgggaaataatatagacgaaatattcgaggcatcaaagattgcatgtgacacctggaatagcaataacccgaagtttcctgtggccattggtgttatttcataccatcttgaaggatacgtgatatttgttgacgggaaaatcaacttttaccgtgatgggcatgaattcaacggattattcaagatcgggaattacaaaacttacatt

SEQ ID NO: 704 - DNA, 6843 bp, Klebsiella bacteriophage F134/15
gcattcagcacctgcgaggagctttcagtaggggctatcgccaacagggtagcattgcggataccaaatttggcgagcctattttttaacccatcccaatccagaccgtatgcatccccaacaggctttttgccattaggaagaaggtccagaggcagaggggccaggtcagctgttaccataccgcttgaatggattgtttctttaccacaagggccaaacatttccgccagcttgttggatgccttgaccagataatagtggagatgtgccatccattcatcgatcaactgtaacccggcgggcgaaccatatccggtgaagttccgcgccaggaagtgagcgacgttgacaacaccgatacccaggggacgatattccttaacagccaggcgggcttggcgggccgggtaatcttggtattcgaggagcatgtccagcgcggacactaatacgaatgccacatcttccatttccgtcggctcatcaaacgccgtcaggttgaatgatgccagagtacacagagcgatacgaccactttcatcatcgtattgttggaattcacgagtcggcagcgcgatttccagacataaattcgagctgtaaatcgtgtcgaggttgaacgggctatacatgttcatgtgatcaacgaatgcgatgtaaatgcgcccggtatcggaacgctgatccagcaacatctggaatacttcttcagcctggagtgtcttggctcgacataacccggcgtctgctgctttgatcatgttttcgtacagagtacggaattgatccacgtcgctgaaatatgcctcgtacatatccatgttgtctttcgggtcgaacaaatacagaggttgtttgttgaccagacgttcaaacatgacgcggttgatctgaacaccatagtcgatacggcgctcgcggttttcttccgtaccacggttgttcttcaacacaacgacatcgtcgaactggtaatgccacagcgggatataagctgtagcagcaccaccgcgaataccgccctgagagcacgacttcagtgccccggtcaggtatttgatgaatggcaccagaccagtgtggaccatctctccgccccggataggactgccgataccgcgaattgcaccaacgtcaaatccgatgccagcacgcttgctcacatagtctacgatagatttggctgtcgcgttgatggaatccagcgtgtcgccagttttgatcagaacgcatgaactgaactgacgggtaggagtacgaacgcctgccatgatgggagtcggaagactgaatttgcctgtgctggcataattgtagaactttttgatcatatccaggcggctggccttgtcccaattagagaacagcgccatagcaatcgccatatacatgacctgaggagtttcacaatagactttcttgtctttttgtagaacggtcacgcaacaggtacttctcagtcagctggcccatggccgcccaggtgaagttcttatcgcgtttgtggttgatggtggcctgaagttcatcaaactcttcagtggtgtacagatccaggaattcccggtcgtatttaccgagtttgatgttcttgacaaagatatccagcagatggggcggcttgtactggccataggcgattttgcggagatcgtatgacttcagacgcgctgcgacatactgatagttcggcttttctacagagatgagagacgcagccgcctggataagaatatcctggatgcggtcggttctcatattatcggtgaattggatctttgatgccgcaatcacctctgacattcgaaaccccgtcccagcccatcacaagcccggtcaacgacggtgtgaagtttttctaatatcaaaagggacagaagatccgtcccgctttatgacgttaatcatagcgatcctcggtttgtgttatatgcaggttgttattatacgccgccctcgcagattgaaggcggcggggaatggtgatgaggtatttaaatgtcgtacaggtcattgacctcaagcatcagacgagtgaaattgccgcgaccatttcgatcatctttgttgaactcgatgatgctgaaaggttgaacccaattaggatatgcatcacccggttctacgccgtgaacagccagagtacctgcttccagtttctggttgaaatcacggaatgctttgacatacgtgtcaagggcgctgtcacgcaaacgtttgttagattgcttgatgtcgccgttaacgaaaacgtaagtcgaatctgaagatctggtgagaaggttcttcagctgctccatgtcgcattcttgagcctcttcgataatcaggaaggcatcatcaaaggtcatacccttgatggtctccagatcctgaatttcgatgatatgcttttcccacagatagttgaagaatccgtcgctgccggtatcagtcttcagcaccttcttgaaggtttcgatcagcgggcgcagatacgggacgagtttttctatacgtgtcgccggggcgggaaccccgcagtctgtccggttggcaacggcgaacgagagatgatgattttactgacacggcgatcaataagatgtttgatagcagcggcagcaccgcaataagatttgcccgtaccagcaggtccgattgtgatggtcagattgttttctaagggcagattggtaggcgagattctggttgtcagagaggccatggaatggagcgattttgtaaatcacctttagagaacttcatccattcgtcttcgcgctgggttacttctttcttgcgcgctgatttggtcttaccagctggcttcatggatactactttgctcgcagattgcatgtgaaccttcctatttctacaggggttatctcatcacctttaattaagcgacgcgcccagcataactctgtcatagataaagaaaaaggaccgtttccggccttcgactaactgaatgatttgtatgctgcagccagcttggtgtcgtactggttctgtgcatacgccgggccgttgtagcgccgagcaaactcagcccaattcttgtccttcaatgctttccacagattggcgtcagccttgatgaacttgacaaatgccatgagctgagcacgttcaccagtgagaaagtcgttgaacatctgctcagcatttgcgtacccgcagataacacagttgaaccccatgatctggaataacccgtaggaagcgctctcgtaggcgcaatctttatcgatcgctattgcaccatggagtcgttccaactccgcgtctccacctttgtatccccggctttggcgttaaccaacgtcgggtaaagctgggccagagcattggcttttgcctgaccgaatttggcattcagctttttgtacatgatgtggcgttcaaacaatgtcttgatcttaccagacttggtgaagccagtaccgcgcgattctacttggttgactgccttgatgctagcaaggtcaacagacaattcacgagcagcgtcaatcaagtcagcctcagtcagatgatcctgatgagactcccctgcgttgcgaatcgcatacatagtcttggggccagcaataccatcaacgaccagtccggcacctgcctgaactgccctgacggcgttgtcagtcgctttaccaaatatgccatcggcaaccagattgaacccgattttgttgagactggtctgaagattcttaacttccagacctttgctgccaatctttaaaatggccataagaaaatacctccgcaatgtttgcagaggtatttaaagtgaaagtgaattacactcgaggaaattccgttacatattgtcgtaaatttctttcaactcgtcaatggactctgcaacagcagcctttaaaccttcgtatgccattattgcagaatcaacataatcgctggtaatattgtcgtcatattctctaaaaccagcaagccaagatctcgtggggagtagatgctgaacatacacattcccacaagaaaggacaatttgggagaaggaacatgtatctatctgccaattttttaaagttatgtgaagccagtaattgtgcggtttcttccgcaatcttagtcgcttctgtgctgctgaatttattcatcgattattcctcatctttccaggatgggggaggtttcctccccctccagcgacttatgccaggcgctcgatcatgttctgcacttcgatcagagtcagtttgcccattttgacatactgagatttagaatcaccgccgaccgcgttcaggatatctgtgttgtcgtagccttttttcgggaataccatcaccgagtaggttccgttgttcagcgggttcagctgcacccggcctttgccgacgttcagggtgccataggtttcggtcttcgcttccacgatgtggatgttcaggccgaacattttcagcatgctgactttgtcagaggatttagacactaccgcctggtcaaccacaatctggtctttcatggtgaagccgcaagcagtttcagttttgccgctcagcaggttcatgaaggaggtcttaccgccctggaaaccggcttcctgtgcaatgcggaacatttctgctttggaaacttcggtgttcagttcgaaagatacagagccgttggtgatgatggttttgattagttttcatgttaaatcctcattatgtagttggtgtcttttctacttttcattcggcggggtgttgtttaccgccctatgtgaactataataggccagctttattgaagagtaaagttctttttcaaataaaaaatttaaaatatttttgaattattttacgaggcctcgtagatagaggcctggagggaagaatttatttttgttcgcgtagttgcttcagatagtttcttgccgtatccatctgatcagcatcaggctgacacgctccagaatcaactaccccattacgccaaccatgtacgaaactcggtgattcataaccactgagaacatatccggctcgggcttgttggtatccccggaggatctcctggtcatccagtttatcaagttctttcatatccatcacactttcctcaaatcggcaaatcgtaaggaagccgcaagcccctggtagacattgtcggccataattttcagaaggtcacgtatcgggatgtttcctttgttcggattcaccatatcattgatatctttccatggtatatccggagggaacaaaacaaccttgacgcccttgtcaatcattttctggataccgtcacagacctgggcgtttcgatattggttgtcgggaacatagatgtcgcctttggcgctcaatagatcagcatctgccgtcgccaggcaatttggtaagaagagactatccagcggcccttcaactaccaacttcacccggttcatcaaaatgcgttcttcgccatagaccttcgtgtcttcattgcgcggtttgacagttgcataccgcaacaccccttctgggaggttatcaccaaatgcgcgcccttgtacaatcttcattcgaccgtcctgagtccagaaggggataaccagtctgggatcatcagggatcttcttctgcttctctggatcagtctcgaaattgagaagatccttccggaagttctcactgaaatacaacaaagagagagcgctctccggcattcccctgccttccacatattggcgagcaaaatgtgttgggtcaagtagatcaagtcggatcatattgccgaggtggtcctcatcccgcttcgccacttgttgaccgatacgcgccgtctgtgtcagtttcttcgaggggtgccagcttttgcgaccgggcgggcgcgggtcgtcccccatgaccttaaacttctccatgctgtactcactgtacagacggtcatcaaatttctcaaccagaactcaaaacgcccaaccgctcatctcattacagttgtggcacttgaaccgatagacatcgtcgtcatggtcatagaagaaatgaccacggcgcttagatgtgctctttttggagtcaccacagagagggcaacggaacttggcgacggctcctacgcgctcccatgagaaacgttccaggcgcggtgccaggtaatttatgaattgctcgtcaagaaatttcatcagatgtttggcctctggaatacctcattaacagtatacgccacgccacgggtttgagcaatacagagctgacgccaagccccatagaggatattgtgttcagcgacggtgttctttacgacatggccgaagtcttccaccatcttttgataatggagtagataaggaggcatcttgccatttgggcttcggcgggctatcatattcagatagtgctgaggggaatacagggaagatatctgcatgtccgggacatggatagccttcaatgattttcgaggcgtgaaatagaacaacccccacttcggtggtagatcttcgatccggatgactccctcaggacatgcataaaaccgatagctgcccattccctgctcaggattgatgcgatgaggcttcttagcatctgctcggaaatcatcccggctgactttgacctcgatacaaaatactacacccagtcggggcggaaaccgattgcatcaggagattcagaattggtatgaggattcggttcgacaaatacggcaccgcaattcatctgcttgtgaagatatttggctgaaatctgacagccttctaaatgagttggaacgaagatcttgcccattacattgcgctccggaataattcaacgcactcaaggcgtccgcttcttttataaacaataatttctgtgaactgtaatccactactttcaatatacaatacgaccc

SEQ ID NO: 705 - DNA, 6797 bp, Klebsiella bacteriophage F134/15
tatttttgattacgggtaaagttaatcgcaatctcacggcaatatgacaggtctacagcagtttggtgactgttatctgctgcggaatccatcattggtaaatccagagcattctcaatctggtcagtactgtactggtccaaacgtttcatttcaccttcaaaatcggaaagcaaaatagaagtatctttatcgtcaggatggaactgttgatacgttgacagccatgcagcgcatttgttcagattgttcgccgggactgccaacgcattgcttgcccagaccacaaagactgcaacgaatgccaggtagaagattatgatagtcgtactttttcacacgcatcattcgttctccttcatcatattttcacagtgaatacgagtctgttgaagttcccgggacagtcgtgggtcatccagattcacagacaaattggtcgataaatctttcaatccggcatcaacccggtcttgatgataacgatcattgtcgaccagccaagcacgaagttccagagcacgagtacgccattctttcttcaatttaggatcattgatctgatcagcactgtattcaaatactttgacgcactggttcccatcattaatgagatcaagatggcgacgcccgatgttgacacctttctgaagcgccgggatggggagcgaacggcattgtctaacctgaatccgccctgctgtgcccatacgcccagtcatgatcaaatctgaagcatccatcccacctttgttgaatttatcgtcattcaggtagcctttgagattataggctccttgtttgtatcgattaaattcaattccggcgttgacaacagcgtcagatacgttgcctgtgttccacaattcagaaaagttctcgatagaaccagtcttgtctatggcgacagcctgagaccatccagcacagtaagaaagatcttcccacagtttctcacctgtggagttcagtttggcagcggcggggagcgccagtccagccagcagcaccccaaggattaaacgtttcatggtgattccctctttttcattgaggaaatagtagttcggaaggtttattgagtaaaggatttcaataatattctttattcagaaacgtgcatcagaaacagtacgataacgcacaccattgaattgtcgagctaatttgacaaattccatggcaggcaaatctactttgtaaaccttcattcgttgcttgccgtccatattcagagcggccacaaaccgatgggaaccatccacgacgtaattgtctgaagatacccaaacccggcccatcggcttcttgttcctgatctgcttcatgatcttccagaccttcattttgtttgatctcgttctgagtcagccgcaatgtccggatcgggacttgagatgaatctatggtcacaccattcgcctccagataatcatggaagtcttgctgtttatcagcgtcaatttgtggcatagaagaacgagaaagcccgaggttccctacaggaatcctcaggccgttgatgatattcaaccagtcgataaaggaagtcaagaacatggcacacctcgggatatggagttatcccttagttagcgcatatgtttagtgaaacagataatgatcaagaataggactaacccaataatcccatacccaattattgtgataatcgggaaccccatcaccagttctcccggcggttgcggatttgttcttggcgtttcatgcgttcagcatcacgtttctcatatttggtgaataaacgatagaaccagatgccaatgattacccaaactacacccaccacaccgaaaataatgctgagcaccaagccgactaattcccaattaataatcataccaaccaccttcttgtataccggtcataaagatgcggagggaatcatattctttccctccagtgttgaggagtttaaccaaatcgtctgcatctgaaatagcagggattcggtacgctcggataataagagctaacagagaattcagtgccgctttcgtatcctctgaatctaccaacatttttgcttccagcatcatggtgatagtcgtagattctttgtgagtacagcccgtgatttccttcacttcatttttcacgcgaaggaatgaggctggagggactataaaatctgtcataatgaattcgccccggtgaatatggcaaatggctcttggaatacagtgacaggtttattgttgacggtcgcgattaccgttacccaaccgccttcttcgatattcccgaaggttttgacacccagagttttattcccgcactggtatatgtccaacacatatggatcttctgctttatcaatcccacgagtggtcgtgtcgtaatggcaatgatatagccgctttgcaccattataaaggacaaggtcagaaccaaatgcctggaaggagtatttgccatcagtggttatacccttgatgacacgatcggcttgtgcagcgaaggaaaggctggccagagccaaagcaatgattaattttttcatgatatagtctcttcaaattgacggggcaatcataccccgtccgcgttattgattttagttaatttgcttcagaagagcaaagaggatttcggccttggccttaatcttgcctacgatgccgtcttcgtctacttcttctgccacccaggacttacccttcttgctaatgatgacgtccttacgctggacatagacttccttcgcagcatacacacggcggaaacctttagcacgcaggaaaccccaattcttttcaatttcaaccgtggtttcgactttcttattactcacgatacgatctccacgacttcctggccatctttcttatgaacgccgacgaaaaataaccgggttggtcttcagaccgcggtggttcagaacgatatagtcgcctttcacaccagagttatcaacttggttgactttcttgataccgtagctcaggatgaggtcagtgagttgggtggccatttcgtcaccttcacttgcaaggcgaacgtatgtgcaaacggattcggggagtagttgttccataatatagcaccttcttcaatcaggcgggagccgttcccgccctacaaaattaatattaaatcatttattgaagaagtaaagccaacttcaaaattattttaataggtgaaccacgtgttcagccaattcacccagggttgggtcgtctttgtgagacccgatccaatgatccgtgatctctacatcatattcttcttccaggtccatgatgatttctatcgcgtcaagttcatcgccacccagatgttttttgacgcgcagaggagccagggattccagctgatcttcgattttgtcaatagcagattgtatcgttttggagtgtttcttctcacgccacagttccatattcagattgtcgcttgcatactggacaaggaagcgcatgacatcgatataagacacattcttagacatttggtataccttatgaaaaggccgggtttccccggcacagttgattagattttgatctctttctcttccagcactgcgctgacggtgtatttcacgccgtcaacttccacttccatggtggactcttccagatccaggtcggtgaaccagccatggccagcaacgatggcatacagggatttggacagggtcttgttcagctcacgcacttgggtgattgcggccttggcagcgtcactgatccaagattcaatgatcttggcctgcgttgcttccgggactgcagtcaccgccggagatttgacaaaggcgttgtattctgccagcgcattagtgatcagctgatcagctgcattcagttttttgttgtcggcctgtttcttcagaacggcggcaattgacggcagcgaggaagcgcctttgatcttcacattgagttcgcggctcatgtagaaatcagtagactcaaccgaagcggtcttcggagagaagccgtaatcgcggatgccattcgcagacagaaactcagccgcttcgaaaccgtatttgcctgccaggcccacggcattacctttcccaaccagttcgtcacggaaatatttgagaaccttctgcttggctttcagggattccagacggacatggtcagcaaagaactgcgcagcactgatgttcttaaccatcgcgcggttaaccagaggaacgctgcccagatttacgatgaacacttccggcccaccgtaaacttcaacgcctttgccaaccagttcagatacggtttccaccgagcagaccacaggaagggtcttcatatggatgataccgtctttgacgatggtgtagttcttccactgccatgtatcaatagattccggcagatcgtatttcttttgtgcgaacttcgggatgatgacggtcccgttttgcacagtctgcagactgatgttcgggcgggccgagttgtaaaccagattgctgacgggaacgcccgcgcctttcactggctcaaacacaggagtccagtcttcgtgctcagccagtttcagggccagcgctttacgctcttctttagatttggcttcggcaatttctgccgccagcttgtcttcggtatcatcggtctttttgtaccgtaccgcgaccgatccgcttgtaagagaacaggggatggtcaacaaccagttgtgcatctgctcccgccaggtaagtcagaacatcaacaacagtagttgcgtcttccggcggcaccagattgtaatcgataccgtccacaccgcgcagcgccgggtctacaatcgctgctgtgatgtcagttttgatgttggaataatcctgcttggtgaagcagttggtgtactgtttaatgaagcgcacatcgccagtctttttcagcgcggcccacaccagatcggcatccatagtatgcacgccaaagagagccagcacatatgccgcttcaacgtccgccaggttatccagttgatcgatcatgtcaggatcaacaacccacagcttagagacgctctcagggatgttgacgtaattgataggatggtcttcatcagactgggcggccaggatggtcggaatcccgttttcgatataaacggcataggaatagatgacgctgaaatcaacgcggacgcgcggggcgacagaaaccatcgctgtttccagttcggtctgatattcttcctggccttcggcgaatacatgggttgcaccagagcactcagccattttctgcagcagttcgcggttgcagttccagccgtattcgatcagggtgatgttgtcgtacgcctttggcagctgctcagcaacggccaggatttcactggaacgccagcagttgtcatagccatccgtcatgaacaccagagaattgatgacgccggactttttctagatcgttggcggtttcgatagccagcttgagcggctcaacaaatccggtgcagcccgtcggttgcaggaaacggtcgatcagtttacccagctcactcaggtcagatgcgttgctgacctggcgcccggcgaacacagtaccgaagtcgccacgagaagagaagtacagaatactgatggtgtcttccggcttaaccaggaagggcaggttttctttcaggtgctggcgcagtttcggcagggcatagcacatggaataagaaatgtcaacgacgatgacgtgattggaaggagcaaccgtctgtgtggcattcttaaattctaatgattcaatcatcgttattccccttttcgggtatagtttaggattggtttcaggattattatccttctccaacattttcaaaatgaacggcttgttgttttcaatttcaaccacaagaacgttctcgggatctaatagacaggaatccattatcgcctcacttgacggtattgacgccaggtatcgttttaattgaggctataatttcttcagctttgtctttttcaactaccacaacaatagtagaaaatttctgctgtttgcgccagttcttgaagtgagtaaccagttggacttctttttcttcacaaccggattcacatttgatgggaatataaactatccccgactcaataaccacatcagcgtcgtcgggaatattctcagtttcaatatcttcaatatattcgccattaacttttatgttgtgataatcatgccaagcatcctgaacccaatactctgggtcatcgtagtatgctttaaactcggcacctttcattttgatcgacataaatcttctccactgtttaacactaggatattatatgcccgaacgtatattgaatccggttttgttatcggaattgggacacaatagcccaaaacaatttcaacaaattatcttttggttgataatcgctgggggagtaacagttaattttttaaccgttttcgcacatatcttggcgatctgtttctttagagtctttccaagaaggtgtagtgtccacaaccgctgaccgagcggcccaacaaagttttgcgatatgaattacaaactgactattaatttcagtgtgattcatataagatctaatgaaatcctttgctttctgtatttctttcgaattattgatatcatcattgttttttatttatcagttttgtaaagacaaatgctgatgtaatccaacaatccaaatttacttcttttaattgatctaatagaatatgcggtggctacacccttccgatagtccaaaccgccggatacttgcattgtcttactttcttcaatataattttcaagttttataaacggttcttcagttgtcttatcaatgaaatcttggacaaccatagccc

SEQ ID NO: 706 - DNA, 6208 bp, Klebsiella bacteriophage F134/15
tcttttaaccctgtcaggaggctcaatcgagctgcaagtcgacaaaacaaataaggaacgccatcatgacgatgacaacgttgaaggccatggctgctttcgtgacctttaccattgccagcgggagtgtgcacgcttcccaaagtacatcacaatgtgactatgatttttctgagcaacaactatccaccatggcgactgcataccacgtaggcaagtcccaatctcttggttacaccctggcagctatatcctggagagagtcccgtgcgggcgaagacgtcgtgtctatgcgatctggtatcaaagccgccaatatgggagcatttacaaaacaaagtacaaagtgttggggatcgggaaggatgtaagaacagaaagtgctatgccaatgtggctgtgaaacttttgattgatcaggagtatgctgccaacgccgcgctggatgagatgaatttctggatgaaccaacataatcagaatgtacgcaagtctctttcatcgtataatgccgggcacgcacgcaacagcaaatcgaattcgtatgctgccgatgtagtgaagaaggctaaatatctgcaaagatgtgtgtctttcaaaggcattcccgcgagttcgaaagttgatcctcaggtgatagccatgaacaagcgcactatagagaaactcaagaggacgcgataatgaatatcaccccatctcaaacaggttatgagcacttgatggtattcctggctattcagggagccaaagagggcatcataacttcagaatacagcgggaccgtccgcttgatcgactacacggccagcgaagcatttatcaagaaatgtatcacagcatggaccaaatatgctgttgggacttacccgacccctcctgcgggagaactgttatttgtcgtgcctaccctggcgacaaccgatactgacgagatctttgccgatatgctgtccaaaggatatctggcttatgacacacagcatgatatctatgacttctcggccttgaatcgggtgttcggttatacgatcacttctgaagcgaatatcccagattgggggatcctggcttggggtaaagatggccttggggcaacatatgcttcatctgatgttggaccagttcttattgatccgggtgttaccatggagcagtaccttgcccaattccctcagcatggtgtaacgggtagcgacatcattatcgtataccctggttctaacgcccttgagcgtcttgtgtccggatgggatccacatctgaaagcggtcgtagaaggtatccgcttctacatcccggtagtaaatcccacagcataaaataattcaataaaaggggcttcggcccctttacttattcaataactacccctatcattcaatacataagcagtacgatgaaacaaattgaaacgaaggaactacattatgaaaattatcctcgacgcatatatccactacggcaagaaatatctgatggcgaaagtgtacgacggtgaaaccctggtacatgcccagacccacgaagattctaaactccgcgaaattttggcgcgtgacttcccaggcgttgaagttattgagccgactaaccaggctgaagttgacaaagagtgggaacgcgagtggagtccggctgcgttggccaccgctgaaaagaactggaataaccgtgaaaacgccaaccgcccgtttcgtcgttgaggataaagatatgatcacattaaaagatttcaccaaagacgatttatttttgtttcatgggtgccgagaaatttgagaatggggacttaccacgaatttactatttctccgacacggaagtggaagtaatttttcgatctgatgggcattagcaacgatcaggacggcggtaattgggcatatcttctgcaccacaatgaaggatttgtccttggttggttctacggggatgaatttcctgaagtctgctggaaagcaggtgacagttccgaaagggttgaatatctgttggaaaaacttgacagcgaaaccctccctctttgggcagcgtcggtcgcctctgctgaacaacgtttttgtaagtataaggggctataatgcccctttcctttcgctaattaagggaaaccgactgctttcttatcaggagaaccaccatgtctatacctaaaatttttagatttcatgaaagagcgcgaccagttggacgaagcgttcaactcagctccttatgaactcaccatgggcaagaaaaatgccggggacgttttctttactttcatcgacgaagacgataaggaataccgcatccagttctataccccgcaaggtctgggtaaaagtgtccgccaggtcttcatcggccagaaacgtggttcagtttaccctgatgccatcgcccgtttcaagaacccgatgcgcgttatcgccagtatgattgaagctaccaagcaattccttgcgaccccgctgggtaaaactattgatggtttcgccgtcaacttctctaagaaagcgctggatcgtggtatgaccctgatcccgaaaatcattcgtcaatccggcctcaaacagaaactgaatgtcatggatcttacctacgcgcctgtccctgaccgtggttacgtttggcttgtcaagaaaggtaaagacccggcccaggtatttgacggtccgaagatgcagggtatcacctgggacgatccagacaaagtcgatgacgttccggttcagaacaatactccggaagtggatgtgccatcccctgttgatgattccaacggctggaaattaacttcaggcggggatcagcctatgatgatatggagtggtagagaaaaaggtacgcttagtcacggcaaatatcgctccccactacaatgaacctggtgtttatgttggcgcgtacatgaatgaaaaacctagctcgcggcccaagcccagactttattacccgccagttgaagttaccacaaattccagtgaaaatgctgaatagttttactaccgcatccactaaattctggcgagataacaaacccaacacacaaaccacgttagacgaaattccgacgactgacatgggccaagaaggtctgcgtgacggtggttatatcgctcgtttgttgggtattattgacacttatgccccgcaaatggtcggcatgtactccggtgagaaactgactcgcgtcggtgcagggcgttacaaaacttccggtggtctggttatcgaagttcacttctggggtgttgacaaaggcaatctggcggtggaagtatcttctgaactgtccggtactgaaatgctgtccctgtctggtaaaaccaaagacgccgggatgaagattgtggaagcgatctccagagcagcaggatctcagttcaacggtgaagtcgaagtgagagcagtacctatcaacggcgcaccgtacccgatcctgaaggtctcccgttcccagggttattcctatgtggactgcggttcgtttgttctgaaagtttctgatgcgctgctggaacgctttactgtcggcaaggcggtagaattagacctcatgcgtgaattccctcgtacgaccttcccggttcgttatgactggtatggtaaaactgaacttgttgtaaaggccagcgatggtaagaccatattcggtagcatcaacaccaatgccagcgataaagacgctgtcgtcaccgctaacctgaaagcgccttccaacggtactttctttggtgaaacggttcacggtttctctgttgcctgggacttcaaattcccgagaggtggtaatcttcaggatgccaaaatcgttaccaacgtgacatacaacttcgataagaagaaagcgaatatcacgactatgatcgtcgagggacatcatcagcacagcagttcgtcttacgacgtaaatctggatgtcaaaactgtacagagcgtattgaacgaatattcggatcgcctgaaaataattaaccaacagctgcgaaacttggattcaagttcgtacaatccgaacaagcggttcctgaacgacgttaccatcagcaaatccggtgagattttgttccagggacagtcattgacccaaagccaaaatcgtcaagtggtcattaacgctctggcgaaggcgcaatccaatgctgagaagaccaaaggtgacttggccaattatgcggcgtcgattgaagcgagtgcaccacaggggcgcgaccttgattggcgggtatacttaaccaacaatggcaattccctgcaggttgattgggaaattactttccgccgcaacacacacgtcggcgccatgaaggaattcagcgctcaggtctaccgtggcaaccgctatctggaagacgtatatgccgatgctaagagcagaggctatgcgccggaacaaccgaacctgatggcgatgtccgatgctcaacgtagcgatgacatggctatgatgaatggcgaagacgcatattccgaatacgagcagtcaatcggcggcagtctgaaaattaatctgaagtaaaatggttagcccctgcgggggcgtaattatgaataaattcttaggagataaacccatgaagacctttctggaattctttactgaacaagcagcgcagcctgtgacccatgctggtgtacagggacaaaagtgttaccatacaaaaagcaagctgacggcactcagtggtgctctggtactgttacccagatcactccagacaacgcagctgacacctataacctggagctgaccgatggtaataccgtcaaagcagttctgaccccggaccaggtacacgcagtgtctcagggacaagaagtcgtagccgttcatgacggtttcgaattcttctttggtaaatctgctgacaaaggccaggtcactgaagcatatgctcaggaactcgccaatatggacaaaatgatcggtaaggcgctgggcgtcggtaaatctcgcaagagcgggcgtaccgaatttgaatattcgggcatccccggtatcggcaaatctgttgctatcgacttcggcggcgaagacgacccgtatgtgatcgtcaccatgggcggaaagcaacaggacatcagcaaaggtaaaacattggctgttgacattgccaagtacctgggtgtcaagcctcaataaggtgaatttatgaagaattttcaagacttccttctgaaagaagccgttgatcatcgacgcctgggtagacagggacaatacgacatcactgatgttggccgcccatcaaagggtgaattgatcgattattatgatcggcaaggtgataagcggcaaggaaaggtcaaatcagtaaatgcacaaaacattatgacattgattgataccaattcaggtgaaactgtcaagctgactttgattaagccgtaatacgctacgatcccccttaaatacagggggagtttctttttcttgaggacactaaaatggtcaatgcaagtgcatttatcaaccgtggtctgctggcgatagcacacacccatgctctccacttcgtcacgcattcatattccaaacataaagcgctcggggagttctatggggacctcgaggacttgctggataccttcaccgaagcatatatcggcgcgggcggcgtatacgcgccaggatttgagaacaccaaattgttcaacccagacccgatccaatatatccagagcatcgttatcgacgtcgacgccatttatcggcagtgcgattctcatctgcaaaatacattggatgaaatcaaaaccctgtgttttctagactctttataaactgaagcaactggcgtagtctataaatcatagcgtgagtatcatacgggaatatttccaacaaggacttacgctatgacatgcatatctgttcctcattatatcattgccttcaatgaacaggataccggaaagactccattggtttttattggagtcacaactccatattaataagctcgttaagtttatcctcggtggttgtcatatttacaagaaaaccaagcattttgcctctatgaatattatttccgtatctgatccatatgtgataaatgagttcaatagcctcccgataagatgtctgactcttcctgacgttaagaaatgcgaagatttcgtgaatgcacacaagaatgagaatgtacgggatgcgatcccggattatgaaaggctaattcaacaggcttatcctgatttggattcccacatggat

SEQ ID NO: 707 - DNA, 5058 bp, Klebsiella bacteriophage F134/15
ggatgattgattatgtctaatatgtcggaacgtttgtttactagaccttagatgctgtctcagcacgagatgaggttgctcaagatgcgatgaaagaaaaccgcattgaagcccggtgttgattatgatgaagaaacgggggagtggttaggtgatcccccggaacgggtatcaaggattcgagatgccgccatcattgtctgaagtcgcgtcaaaagaatcaaaagttacctgaatacgaggacactgatgccacgactgactacaaacgtattcgtgacaccacatatgctatgcaagaagccacgatgttcatgatgggcaaggccgctgaactcgccgcttctacagaggctcctcgtgcattcagcgtcttccgcgagctgggtgaactcatgcgtggtctcaataaagacctgatggaaaaccagaaaaccatcaaggatgttactcgcgacaaagagccgccgggacagaccaccgttgaggtttctgaagatgaaaatggaacgactacagtcaaagtcggcaagaccgctcggtcgtcaagagatcttctccagatgattgagaaagttagacgtgatgccgaggccaatcgaaattctcgtgttaatcccgatgaagaagtaattgacgtcgcggaagaaccaaaacaggaagagaagtcagagggtgaggacgatggcgtatccgaagcgtgaagtcgaatatgccccggtcaagacggggtttaaaattgaagacgtcaaattgcgtatggaccaaacgttcatgcgcaagccgactgtgcgtgctcctcgtgttgaattagtccttactgatgagcaggaagaagaatatgtcaagtgtgctatggacgcgcactacttcgctgcgaactattacaagatcaccacgattgaccatggtttcatcttatttgacatgcacgattatcagaagcaattgttccatgatttccaggatcatcgattcaatgctgttgtgcaggctcgtcagtcgggtaaatgtgttcggggcgactctgaagtttatgtttacgatactctcagccaggaagagttctctatcaccatagaggagcttcacagccgcttcgaggacgttaaccatgcagagccgttgaataccattggcaaacacaataaattcgtagatagccgcttcggcaaacgatactttgtgaagtctgacagtggttgggttcctgtaatcgcagcacacaagacaaaagaatatgcagaatatgtggtaaaaactgaaagtggccggacgattcatgtcgcggacgaacatctattctttaatgaatataatcgtgaggttttcgccaaagatctggaagccggggatgccatcatgacgcaagatggccttgaatgtatttctgaaatttgggaaaccggcgaatctcaccacatgtttgacctccaggtgaaatcatctgagcagcgttattacaccaacgggttcctgagccataatacgacagtggtggcggcatttctcctctggtatgcgatgttcaactctgacaaagagatcgcggttcttgcgaacaaagagaaacaggctattgaaatcctggaccgtattcgtaaagcatatcaggacatgccattcttcgtccaacaaggttgtgagaaatttggttcaactctgattgaatttgagaacggttcgaagatatttgcatacgcgacttcttcggactctatccgtggtcgttctgtatctctcctgtatgtggacgaagtcgcattcatcgaaaacgactttgaattctgggaatcaactttccctgctatcgcccaggcagagacttcgaagtgtatcctcaccagtacaccaaaaggtcagcgcgggctattttacgacatcgtcacgaaggcgaatccagaacatcctcaatacaacgacttcaatcttacggaagttccttggtacagggttccggcgtacaccaaagacccgaattgggaatccaaacaacgtgccaaacttggcgacgctcgtttcgatcaggaattcggtatcaagttccgtggttctgtcggttcattaataccgtcgaaatgtctggacaagatgacatccaagttgtatcaggagccgaacgagttcaccaaaatctacaaaccctttgacaaaaccagaacatattttggtattgcggatacaggcaaaggggttgagggggacgtactctgtgctgaccatattggacatcacggaatatcctcatacgattgcagccaaataccggaacaacacgataccgccgatgatgtatgcatacacgattgccgatatgtgtactcaatatggtgaatgccctgtgcttgtagagactaacaatgatgttggtggtcaggtgatcacaatcctgtatcaagaaattgaatatccggaaatcgtgtttacatcaacggacaataagggtactggtaagaagatcggcgggcgtcgtcctgaaccagggattaacaccaacaagaaagttcgctctatcggttgtgctaacctgaaagcacttatcgaaagagagatgttggtaatcgaagaccaggatacgattgatgaactgagtacattcgtgtttaccgggacccgctatgaggccgatcagggttgtcacgacgactgcgttatgccacttgttttatattcatgggccgtaaaacaggaatggttcagtgatttaactgacaccagcatttcgagagatatgcgcggtcgtatgaatgcgatggagcaacaccaagtcctcccgtttgggggcaaatttactggtgatacccctcatgaagtacagcatatgccgggctttgggggtgtgaatgtatttgatgaacgttctgggatgtcaatggaagagtggttcaagaactgatcactaaatatctttcaaattgagcgaaactctaccgagaaggaataatattatggcaactacaagcttcagcgttgcgccgtctgtacagtggaccgagcgcgatgccacgcttcagacatctccgtccgttgttgttcagggcgcgtctgctggtaaattccaatggggtgaagtagaattgcccgtgttggttactagcggtgagactggtctggtgaagaaattcttcaaaccgaatgatgataccgcgatcgactttctggtcatcgctgactttttgtcgtacagttctgctgcatgggtgacccgtatcgtcggccctactgccaagaacgccgtgactaaaggtcagagcgctatcctcatacaaaaacaaactggactttgagaccgcaagtccgtcggcttctatcacctggactggtcgttatcccggttctctgggcaacgatatcgccgttaacatctgtgatgctgcgtcattcccgacctgggaattccgtaacaactttgcctatgctcctcaggctggtgaattccacgttgttattgtggacaaagttggtcgtatcaccgattcttccggcgctgttggtcaggttgaccgtatttctatttctggtactgctaccgccgctggcgccattacagtagcaggtgaatctgttgcatatctgcagacggatactccagcaactctggcggctaaaatcggcctggagatggaagcgctgactgatgtttattcgagcgttgttgtgaaatcgaataccgtcattctgacacacaaagctatcggcccgcagcctgttaccaccgtggttcctgatgctaatggcctgactggtactgcgaccatcaccactgttggcgcatccggtacgataatcgagaagtatgaactgatgcagaatacccagggttactaaaaaatccgacggttcgaacgcatatttcaaagatgttatcaacaatacttcgaattgggtttacaccttcactaatgccctggcggcaggtgtagttgaactcgaaggtggcgttgatgattacgacgtcaaccgtgtcgctgctatcgaagccctgaacaacgccgaagcatacgatgctaaacctgtgttcgcatactgtgaagaactgatcgaacagcaggctatcatcgatctgtcgactaaccgtaaagacacagtgtccttcgtgtcgccgctgcgtgatgttgtagtcggcaaccgtggtcgggaaatggatgatgttgtggcttggcgtgaaagcctggtgcgcgattcttcctatttctttatggatgacaactgggcatacgtttacgacaagtacaacgacaaaatgcgctggatcccggcgtgtggtggtactgcaggtctgtgggcgcgtactattgagattgctggtatctataagtccccggcgttccataaccgtggcaaatacaacaattacaaccgtatggcatggtccgcgtcttctgatgaacgtgctgtgctgtatcgcaaccagatcaacagcatcgtcaccttctccacagaaggcatcgtgctgtacggtgataagactggcctgacccgcccgtcggcgttcgatcgcattaacgtgcgcggcctgttcatcatggctgaacaaaacatcgctgccatcgccaaatactatcttggtgaaaacaacgatgcgttcactcgcagcctgtttagcaacgccgttcgtccttatatccgccagctggccaacatgggcgcgatttatgacggtaaagtgaagtgcgacgaagacaataacccggctgaagttattgctgccaaccagatggttgctggtatctggctgaaaccagaatacagcattaactggatttatttggattttgctgccgttcgtccggacatggaattctcggagattgaatccggcggcggtattgtcgcagcgtcataagacaccaaaccccgcttcggcggggttttacttcggggtaaataatatcggcaacccggagatttgaaatgatatttgcatacaaaattgaaatgatatctaacaacaaggtctacatcggtgtgaccaatgatccgcaaaggcgatatgagcaacatttggccaatgcatttcaatataatgttgaaagtgaattgtatgatgccatgcgc

SEQ ID NO: 708 - DNA, 4848 bp, Klebsiella bacteriophage F134/15
attaaggcaagcaaggacggcatctacaagcaaatcgtaccggatgtcgaaacccttgggcctatctatgatctcaagtggaacatggaatgtatcgactatctgaagacggcggcggtgttccagcgctgggttgaccaatctatcagtaccaataccttctatgatcccgagaagttcccgggagcaagatcccccgcgccaagatgatgcaggatatcttatccttctatatgtggggtggcaagactctgtactacaacacaaacaaagactccaaggaagacgaggagctgaaagcagctgaagaagtttgtgatacctgtgtagtatgagttaggtctatatctcactgtgttatattatcaggggtggagcaattcaccccattatccatcaggaaagaattatgtctgaacaaaagcaattttccgttttcgacccgacatcgaataaccagggactcccgttctttggtgatccggtatcaatccagcgttatgacgttgttgcttggccgtttgtacagaagtggtatgaaaaaggcctcagccaattttggcgcccggaagaagtagacatcaccaaagacaaggcggattttgccactctaagcgatggtgaaaagcatatctatttctccaacctgaaacggcagaccatgctggactctatccagggcgcggccccgtttgaagcattcggtgcctgggcttctaccccggaggcgcagttcgctatcctggaatggacccgccaagaggcaattcactctctgtcctacacccatatcctacgcaacacggtcaatgatcccggcatcgtgtttgaccatgtgctggacgtagctgaaattgttgattgtgcacaccaaatcagcacctgctacgatgaatctgtgcgctgggcgggtatgcgtatggcgggccggatcttcacccgtgaagatatcatgaatgccaagcggtcattctggcgatccctgtttgctgccaacacgctggaaggcatccgcttctacgtttcgtttgcatgctcctgggcattcgtccaattccttcaaaagatggaaggtaatgcgaagatcattcgccagatcgcccgcgacgagcaggaccacctgatcctcactcagacattcctgaatcgtcttccgttgatggatccggactttgctgtcattcgtgaagaacttcgtgctgagatgacacagatgttcatggatgtcgtgaatcaggaaaaacaagtgggctgactatctgttcaaagaaggttctatcctgggactgaacgccaagatccttcatcagatggttgactggctggcgacccaccgcatgggtgctatcggccatccgtatcctggggaaccgcgcaaagacaatccggtgccgtggattaacgactggctagataatactacaatgcaatatgcattgcaggaagcagaagctcctgattatctgatgggcatactgactggttcagtatctgacggtcttaaatttgcataaaggtgagaaatgattacgatctattccaaacaaggttgtgcacagtgtgttacagctgagaacatctgtcgcattcgcggtattgagcatcgtatcctcaaacttgaaaaggactacaagttggaagatctacaagctctgacgggcaaacaacgcatgtctatgcctgtaatcgttctcgctgaccagactgtgaccgacgttgctggtctcgccgcaagcgttaaacgctgatcatatcaacgcccccggaagtgggggcttttacttttgaaaatctcaaacctatacttcctgtacaacacaaatattgaacagcaggaactacatcatgtcgaacatcatcttacgcaaccccggccatcattttggatacatccaactcccgttggtcatcgacactttataccctgaagacaaagaacagatttgttggtctccagcggccctcattgaacgagagatattcaaatcagaagtggatgtcatgtaccggtttggggaaacgggcaaattgcaatatatgggcaaggccaccgagttgcgaaccaccagagaacaaagatttcttcgtattgatacgacaaattgcgaattctttgttcttctgaaggaatatgtgacacggaatcgtccggtttcccagcaccgcccgttcttgtcaagtgtgcatattgacaactttatctctgacgtccaccttgtggcttctactcttcacgatgaagaaactggtgtaccaaaggacacagtcttaaatatggttgtgatcacattagtggagtaagccgctatgagcgatttagtcttgaatacccaattccgtcttcctgtggattctcttgttccgtttcaaatcatgaaacagatgcttgaagaaggcatggaagttccgttaaaacataatggacaagatatcgggcgctgtatgagttgctcaaatgccgattgaggctaacactctcatggaatgggtttcattttcaaattaaaaccaccaattcggttatacgatatcaagcctgtggtaatacagatacctgctggcaaatcaacttacatgtacttgatatcgcattttatgttttatgacgttgcgccgtcagttggtccgttgtaaccagatggtgtcagtaatcggttcaggatcattcacgacgttaaacgtaatggtgactgccagggaatggtagtcatcagacagagatacttcgacagactgtatttctgccctcggttcataaagagcaatagcatcttcaactttgttcttcacatccacctgaatagtcggcgtcgtgttttccccgagcatcccataaaggccagcacccatatctgggagagtccgccattcgcctgccgacgacataacaatattccggacagactgtaacacagccctattttccagatttcatcgtgacgtctttggtaacaggatgcatcccaaattttaggtccacatctttataatctttcatgttgaggctccctcagcagcacggagaggcagtatccgcctctcctggtgtaatcgtagtggggttattggctggaaccaaaattaccgccattgtcttccagttccggtttgatatcgatagtgcccggccctgtcggtgacgctggggttgcaccactaagagaactggcccggcccgcgccttcggcatatttgatattaccgtcaatggtctgggctaccgtcaatttatcagcgatgatctcggacacgaggatcttaggaaccttcaacgtacctgacacttctaacatctgacaaacgatacggaaaatattctgcgcctggatttcggcaagctgagaatatttcatcaaagacgtaccggcaaccacgtgtgaatgattgctggaatgcagatgataaacttcgcctgtcttgcgctgaacttccgtcccaccaacagtcaggttatggtcacgcccgacgtaataccttttgttcgaacatcgcaatatcatagtggtcttttactgatttattgaccacgtcaccattcggtaacatctgtttataggaacccgattggtgcatccagtggagacgctcaccaccaggcgtatcgtctacttccataatgtgaccagaacgggaggccataacattgttgtatggatacaccgaaccgccagcagatggaactatggtttcacctgtgttatcaatatcctgtacccgaccagatggcggcggggtctcttgtacttttggggtgcgatcaggaataggttcagaccatttgctgttttgctgtgctggagcagccgccttcgtgttcgctggaccgggccaacgatatcccaaaaccgaagaacgactgaaacggctgactttcacgctgtcagattggttgcccccaaggcaccacacgataattcgcatcaaacttctgaacaaacgcgacatgaccaaaagtcgggttcgttcccccggcggaatacgaccactgctccatatcttggttcagacaaaggagaaccccattgaagatatgaacgggccaaagcagatcgtgtagacgtgaacccagcctggaggagaacccaaccaacgaatgcagcacaccaactcacttcgtcttcagatgctccaagagaagtggttttgtgatattctacaatccttgggttgttgttaaatttaccagcatattccttcacacccaattcgcctcgagcgacagtcatccatttttcaggatcatacccatctttgggcggctctgggtcaggttgaggttcgtcttctatttttacaggaacatctgtaacagcattatatttttgacgttcaatagactgcacaacctggccgagagccaacgggttggtgtcagaaccattaacctggttggctgctggccatacccacgctattctcaaattctggtatgcttcgtcaagggcgaaccccatgacttcactgttgacagtaataccagtcggagaccagcctaaacctgccgaggacgcatttgttgcaggcatcatgagcacagcccatggtaacagctcagtaggcaggagagtagtgtcttgggtgtgtacgccgtatacacggacggcaacgcgcccgttttcttcgggatcattcacgtcttcaacgcgcccataaaaccaacgcatattttctaacatagtgatgtccaaatgtgtagaggatgttgaagatatttatgctctgtcgaatataatattataggatgcgtcagcatccgttgtatttgatttatttgtttcaactcgctttgctcgtgaaagaccgtcttacgcagacagcgcccttccaatgccagggaggcataaggcg

SEQ ID NO: 709 - DNA, 4517 bp, Klebsiella bacteriophage F134/15
tttctaagacaaaactactatagatggagtacaaaatagcacaattgaatcttaaccgccgcccgtattgggacgactggaatccagagaagcgtttcagccgcatcctgttccgcccgaatccaatcaaagtacagactcgtgagctgaaccagctgcagactatcctacaggatcaaattgagaagatcggtaatcatcttttctaaagacggttccatggtaatcccaggcggtttgactattaccaattctgctgtatccatgaagttccagctggcgggtgggagcgaattcactgacctcgaaggcattcaagaactgtatgtgattggcaaggacaacaacgccaaggcccgtgtattgtctctggaacgctacaccagtgaaccggatatgatgttctgtatcctggaaatgaccgagtccggcactgccgatggattcagcccgaacgataatctatacttcaacacttatgatgtgaatgataacttcatccgcatcggttatggtgttgctcagactgtcggtggttctattgttgctcggatgaccaaaggcgtctatttcgttcgtgggttcttcctcgacgttgacgatgatatgttggttgtcaacaaatatgcaaataacactagccatcgcgtcgggttcaaagttactgaagaaatcgtgactgaagagcaagatagtagtctgttctccaatgcccagggtacaccgaacaccaaagcacccggcgctcatcgccttcgtttggatctgagtcttcaggcgtttgattatgacgcagaagtcgaagatttcgttgagctggcgaagatcaaagacggtaaaatccagtctatggtcacccaatcgacgtacaatatcctcgaagacactatggcccagcgcacctacgagcaagctggtgactacaacgtgtctactcaccagatcgaccttcgtgaacacctgaaagaaaacaacaatggtggggtttatactccgtccgaaggtggtgatgaaagcaaactggttgcggtaatgaagccgggcatttcttatgtccgtggtcgtcgtattgagaacgtcggggaagaactcgtagtcattgataaggcgcgtgatacagacctgctgaacaacacaccagttgctgtagcgacaggtaatttcctgacgaccaagaactctaaaggtgttcctgttatcagccgtagtattcgctacaaattgctgaatgcttctggtgttacccaagcgactgccctgtgtatctccgccgaccgtaccgggacggaattccgtctgtatatgcgtgacctggtcgtcactggtgatatgagcacggtcaccaaagtcgcttacgaagaaagcgggaccacgatgttctcggcagcgttggaaactaatcagttctcacaaagttcatctatggatctcatatttgaactgcctgtgtttggcgtgaaaactttggctccgaccggaacgattgatatcaactacaccgtcttgcgttcttacaaaattacgctggacgcatcaggcaatggttctatatccgcaccgctgggatacagtttttctccggaattctcactctactccggagcgaaatctgacggaaccgccgcccagatcgatatctccagtagcctgtctctgaccggtacgcctgttgggtcggctctgcagatttccctcggttccggtaatgctctgcaatctatcaacctgttggcgctgatggtacgcaccactgctatcatacaaaaaccaaaactgtcacgactgcgactgagactgtgaccttcaccaaccaggccagcattcagcttgctaaccatgacggctataaattgacttccgtacaaaaatgccaatggcgctgacgtgacctctaacttcactctggatggcgggcagcgtgatgcggcgtactacaagtccagtctgatatcggccactggagccatttcaggcgcgtataccgtggaatacacgtatttcgctcacagtactggtgacttctttacagctgattcgtatacttcgattgattacaaatcaatcccgaattatacgtcaagcacttctggtacagtgtatggcctggctgacagtattgacttccgtcctaaaatcaccaatggtgcgtctaatactgatatggtgcggcctaacacggcgatcatcatggacgttgaatattatctgcctcggattgatgctgtatacctggcagacaacggcgttttcaacgttgctcgtggtatcagttctaacaacctggcggctccggctattccggcaaacgccatgcgtttgtacgaactgttgattcctccgtatactccggatattgacgatattcagatccgcactatcgacaaccgccgttacacaatgcgggatatcggtaagctggacacccgtatatcaaacgttgaatactatacaacgctgtctcagctggaatcttcggctatgactcagcaagtattcgacccggtaacaggcaacccacgttacaaaaatggtatcgccgctgatccgttcaaagacttccgtctgattgatgatctgtcttcagactggatgggttccgtcgacaccgacaatggtcgcctgcgtccgtttgtacaacaaaacgcgattgatctggtcccggatgggtgggacaaggttatggacggtatggtcgtgtgcaaatacacgccggaaatttctgtcaaccaggaatatgcgacgacgacgatcaacgtcaacccatatgctgtgtttaactggacggggttcctcaaactcaatccgacaacagattactggtttgaaaactactatgttgcacctcgtgtgatcaacgagacgatcaatacccgtggcgctgtcaaagaaggtacggtttatggtacatggcggaccgtgtctgtatctgagcgggtatgggagccacacggcgcgggcggcgtatggtggggatatcgttatagaaccactgtgtctacacgtgatgtttcgacttacacgtacacggatacaactacgacttcactttctggcgaacagattgttgaaactcaggttattccgtacatgcgttcaatcgaaatcaactttgacgccagcggcctgcgcccgttcaccagaatgtatgcattcttctctggtcgggatgtgaatctgtactgcaaaccgaacggcggggcatatggtgcgccgttgacgacggacgccaacggtaatctgaaaggtgtattcaaagttccacagaataacaccattaaattcaatactggtgacaacgtcttccgattaactgacagcccgactgatagcaagtctgctgatgatactctgacgaatgccgagattgttcataagtcctttggtaagaaacaaggtatccagaagacctatgttaacacacgtgtgctgggttatactgtatcgactaaatctgaaacaacttcgtctgaagccgttgttggtcagtggcgtgatcctatcgcacaatctttcatggtggcgacaagcatcggtggtgaatacattgaaggcgtggaagtgttcttctcaagcaaatcacgtgatgttccagtaactctggaaatccgtgagatgagcaatggccttccggcaagtactgttatcacccggaaaactttgaacccgtctgacgtcaaagtatcgaatgactcttccctcgggacgaaattcactttcgattatccagtatatctgcaggctggcacagagttcgctatcgttcttctggctaacacccaggattacaatgcttacattgcagaaatgggtaaaaagatttgctgtcgaatgaatatatcgccaaacagccgtatactggcgtgttcttcacttcttcaaacggttcaacctggtctccaaaccaaatggcggatatgaaattccgtgtgtatcgctgtaattttgctgctgccgacaacgtggtgacatttactccgaacgccgggcctaaaataccgtcctcttggcctgaatgtgttgaactgcgtcaacggttctacggtggttacagtttatgcacccggccatggtcttgttgcgggcaactctgtgacattatctgaactgacgggcggctgcggctttaccgcagagcaactgaataaagttcacaccgtcacggatgcgagctatacttcattcaagattgatgttggtgcagcggcagacagcgatggacagattggtggtgaagacggttctttcttgggcaattacctggtggatatgttctatgccagcgtgaccaattcagccctggaaggttctatattgaaactggaataccgttatcgtgattctacgtccaattctatgtctgattgggccgagttcgaatccgatactgatgttcctctgccgacagaaggcatttatcgtcaggccggggacttccaggtaagagccaccatgactcgcagcgcgagcaatgcgtacacggcaccaatgattgatggtgatgacttaaccgtggttct

SEQ ID NO: 710 - DNA, 4247 bp, Klebsiella bacteriophage F134/15
  modified_base (1279)..(1279): a, c, t, g, unknown or other
ctctgttctaatcggacagctgatctgaatcaaaccccgcccatgtgcggggtttttctttattacaccctcagtgctattatattatggtctatcactgaggaaacaaatcatgaatctgtcaggagcagcaattgatgttctataccaacttttctggtttgggccaagagaagctggtgaaattccgtctaaatctggtgagttggaattgttgtctaaagggttgtgcgaaagattagatctggtttctacacccaaaggaaaagatactcatctctgcgttttgactccaaatggttacatccaatcccgcgctctttttgtccattccaacaaacaggaaacaaatcatgaacacaaccaatattcaattaaccatttcttccctgattccagcgttcggtagcaatctggaacaaatcaatttcatccgtaatcgtctggaagatgtggcgtttcaattggggtatgtggaacctcctcaggaagtaaaagaagcggaggatgtcgcatcaccttccaacctgatcgatgcgtatgatgaaatcgggcgtaaaacgaacgttgtcatacagcaaatttttgtaatatatcgggtttatagaaaaagacgctggggaattcttaccatccccaatctgattcggtcaaggaaattgttccaacgtccatttctggaacatctaatggcatttaaaagaaagggcgcagttgcgcccttttatttgggggttttagtgtactcaaatatctcaaactctgaagccctgtctttggctaaacgataccatttcttcaaggcccgcgccgggcattcctgggataaaaaggcgtggatcaagcaattacagatacaaatagagataatggagtctctatccactcagtgcggaaataacccattcgctgcccgttgtcttgaacaggagtatgcaactcttaaaatgcaactgaacactgcgatgtcacacgttttgcactcttaacttttcaataaacagatttcaattattattcacccacaatctaaacgaggaacaactgatggcccgcgaagacaattcacagatttctaccaacgccaactcaaccttcaatgagtggcacaacacccttgagcgcgtagcacgttctcaaggcggttcagctgctgacgccgatgcctggcgtgaagattatgacaacggcaagactccgcgccaggcatgggaagacgaatggggagtgggaagatgcagacactaattcgtaaaatctttctggaataaaaaggggntggaatcaaaggtcgaaatcatcacgactacaaaaattagtttgtagaaaggtgaaactcgatactatcttaatgtgttcctttaccttccagaatgcagcctgaaccgcgatattacccaaccggatggaactgtggtccgttgggaaatagccaaacaggaagatgttagaaaaagacatatcactttgaagcgagatctatatcatgacaaataaattcatttttctggacgttcgcggtaaacgattcttcaaaactgatctggacgaaaagacagaagggttccaggggcgtttatcatatttgttgccgacaggcgatatcgacacccaaagatatgtggcggatgtacgggatctcctggattgtggttgggttgaaattcctaacccccaggtgttgaccgtcaatctgtattacatgaaggaaagtgggaagtattattccaatggagaactccacctccttcgttctgaagtcactgccgatccagccaagagttggtacaatgctagagaaaccgtccggaagatggttgatgaaggcaatttgcctggcctggtatccggttctcgttacgatgtgttcatgtcctgtgaagagcacccgtgttatgtgcccactttggtgaaggtgaaatgatgaaaactctcgaacaaattttagaaggtcataaaacaggaactttgtcagcggctttagacggtcgcgatttgacccgtctggcacagttcctgacagttgagcaaattgaaaatctggatttgtcttttaaatctccagaaggtcgtgaaacccatgtcccggttgaattcaccaaagaaaatatcctgaaacaactggaaaaggacgtcgcctttgggtttgaaaaggctctgaatcgtcgtgggattagttctggccttatgtacgaagtcgtacaaatgtggaactgtatccttgaagaaggtctcgaagattttgattcgtatgcgatgtacggccttcctctgtttaaagcaactgctgtcaaatacgggtttgacaacccaatcggtgatgacacaggtgctgaagatcattatgaagagcagggctattaatatgcgtatcaaaaagatcggatccagcccgctgactggtactatcttctacggcaccctggaaaccaaaaccagtatgtgggtaggggataaaattgatgtcaccgaagagtgtgtcgcagcgacggctgagcatatgcgtcacatcaagaaagactactgctacaaaacggctgatggaaaatatctggtgttgtctgctgaagtccacgatactcttccggatagattcaaataaatttaaaaatattcaataaacggggtttacttcttcaataaaccccgtatacttcatttcataagcagtacgacaccaactctgaaatgaaggaactacattatggcacgtacaatccacgattttaaagactccgatatcctgacctacggtatgaacggtcgcctggtagttctgaacgacggtggtagcgaagaacgttataacaccactctggttttacgaaaacaaagtgatttactccaacacccgcgaaggcatgaaacgtgccctgaccaacccgaattctggcctgacccgtttgctgcctaaacagtgccatgcagttgcccgcgccctggctggccgcttctaacctaaatctgaacgccccgtccgggggcttactttgaaacgaaggaactatattatgatcactcctaacattactgtgtacgcttttgacgaattcgccaattttgattcattcatcaagaaatttggtgtggacaacgtcgcggctaagcaattatatggttccgatcacctgagtaagtccacccagatcaaggctacgttgggtgaattggtggaggctctgggtgaaaccttccgcgctaaaatctataagaaagacggcagtctgcgcaaactgaaagacaagactgtcattcacgaggctgatcagtttaccgtgtctatgtatttcacgtttaagcctgaatatgaactcttcaccaacggcgacgattctacccattacgtcatcgccaaaggcagcaatcgtccagtatttgaatccggtgacatcatggcagcaatcaatgaaatggaacgcctgaataaagcataactattcaatagtcactatcggggtatgataaacttcgtactctacacaaattgatgaggtctatatatcatggcttgtgtgtcatctatttctaaaacgcctcccctcaaatggagtgggaatgagcacagcatttatgcccgcattatttctgcggtaaaggaaggacgtgaaagcatcgaatttttccgtccggctatgtcatccaaagcgcatcgcaacacatacgtccttctgaataatcttcagagtctgggtgtcaatgtggagcctatgccatgcagtaacccgatggtcaatctcttcattttgagcaacttcgagaattggaaatgaagaccattattctcataactggttcgcgttctattacagagcgcgacaaaatctttagaaaagttagacgaactttctcatacagattccgtttgtaatctgtatcttccgtgcgagaccctattgatcgcgtggggaggctgtcggtgtcgatacgatctgcaaagattgggctgaatccagaggggtgacttatcttgggatgcctatccccgatgaatacttcgctacatatgggaaaggggctggaaacaaacgcaaccaggacatgttagacaaggcgttggagttatcacagaaatacaaggcggagatactgcctctggctttctgggacggttcatcgactggtacacaggatatgatcaaacgaatcaacaaagcagggttgtattgtaaggtcatgctcttgggtaagccaaaaaccaaaacgccttctgtaatttgttaacactggagacgtcccatgatcatttt

SEQ ID NO: 711 - DNA, 3971 bp, Klebsiella bacteriophage F134/15
ctgtcggttatgaaacccttccgtcgatctggcatcgagccagtattcatcaaactggtttatgctaagaaatttgctgtccgcttctggagcaattttctgtatcgcctcccctgatttaaatacccccatcaattgggggtattttcttatgaacgcacaaatttatgacgcccttgaacaaggcaatgcatttaacaatcctctcccgggattctctgctacttctcagacgttaatcaccagtggccaacaaagtatagcaggtattacaagcatcccggatacgtccgttcaggcggcgataaccgctggtggtttgactcctgctaaactcaatacaatgaacaccatgtacgggactgccaacaccgggatcgggactctgaattcttatggtgaccagaccgttaatgaggcatacaataggatcggaacttcagtatcctataaatccggcctcaaaagtattgaacgagaacccaccaactgcgatttgattaacaacgcattcggtgtcgtacagacactcggtcgtcaatggttgactgcaatggaggatgccttatctccaataacagacaaaatccaagaactgtatgatctggccaaacaaggcgcggcggcggggttggccaaaatacaggcattagcctcacaggtcaacggattaatcaatgatgctgtagcaaaggtgaatggtgttattcagaacatcactgatgggatagctgctgagttagctcatattgaagacatggtgaagaagtgtcttaatttctcctttgctaatgttcttggcgaatgggcaaaagatctttgcgcaggcggtgtcatcaacaatatcggttctaatgatctgaaaaatagccctgaaatgatcagggcacagtccttgctggcagaactcccactggctcaataccttccaccaggagggagttcacacccacatcgctcaacctaatccatatcttcccaccaggcttaatttcaaaaacgttcatttcatttccaaccgcctcattattcacaaatacgccttgtgttgcgatcctgataggtttcttcgtgttgtttgtgatttgaaatgtaacagttatatccgtggtcagattaactccctgtttcatggtgtagcgttttattttgtcgtagaaagatgggttgaatgtgatgatgatgctgttgttctgtgagtaataaatacttgctgacaagtaaggaattttgtccttcttcccctttgcgtaaaagagggatggtggttttccagtatggtcgcaaagtgtctttattgtcatcaaaacaaccgacaggctggagattttgaaaactttgaaacaaaatggtggcctcatccagcatggatttttcacatttgttactgtctgttgaaatggttactggtacaacacggacatcagtatcccagaggtcactaacggaaatgatgggcgtgacgaaaatacggcaacttgtcaatacaagcaccataaaaatcatcacaatccatcttctgattccgcgcatcagggacacaattaatctccacagcaaaggtgctaacaatgtctacttcagtccaattcaaacatgacaacccaaattatgcagcatccgataagtggcgcttaactatcggtgatctgatattgttatcccgctctgtacacgattttagcataccaggcgtgtattccgagggcatcgatgggccttcgcccggttcagtgctcaacacgatcccttctgaacgtttaacatatgatcccatcgtatttacgttcgttatcgatgaggattgggtaaactgggaaaccatctacaactggatagccagtaacgccgccgctgatatggctgttagtaaagacatcaccatagaattactcaacaacatgaaccgcccggttggcctgcaacttctgttagaagaagcacgtccaactgcattggacaacgttcttgttgatgtggacgcttctgttccccaattagttacaacggtgactttcaagtatctgaaactgacaccgacccgtgttgtccgcgaaattgataaagaatgagttataatagagagagttagaaaaggtgggaatattttatggaagttaacaacactcaatatcaaacgatgtctatagaggacatcatggctgaactggatccactgattacggttgatccggctgatcgtaatttagatcaaatttcgttgaagatcggacgttcctttatgacagtgcagcggcattacattcgtgaagggcggttatctggaatatctgactgggcggtttaaacagtattgatgtttatctgcggaggtattatgccgggaattacctgcgcaatcgtaccgagatcgtcctctcaacaacaaaccactgaaaactgatctgcctctatgggttcaggctgatgatatgtatgttgagatgtcaggtctcctccaagagcagaaggcaaaggtgaaattcatagaaagctgtttggatcgtttgaacaagctgggttatgaagtacaaaaacgccatagattggcggaaatacatggacggtatgtagtgatgagccgactccaggcactcaagaagatcaacaatattgaggaacgtcaatatacatttcagcagtacgaattaccgtacaaggagctgacttgtgtaacgaacgagaatggacgccattacgtttccccaacaggggtgaagttaacctctgtaacaacaatgttggggcgtaccagtgaccatacatggttggatgcctgggtcgaaaggcttggagttgaacaagcagcaattgaaacacaaagatgcgctgataggggagaggcagtgcatcttgcttgtgaattatatctgaagaatgcgccgatgaaagatgttgtggccgccgccggacaatatctgttcatgttcatgcaattgtttccctatctgaatcgcatgacaaagatatatgcccaggaaatacctctatatagcgaagtattgggcttggccgggcgtgtggatttaatcggggtgtacaacggaaccccagcaattatcgacttcaagacttccaatactctgaaaaccagggacatgatagaggattacagcatccaattgtgtctgtattcagttatgtttcaacagatgtttaatgtcaaaatcgagcgtctcatcaacatcatatctaatgagaatggtttactgccgacagtaatagaattcgacagaaaagatattctcccaaaaatgttcgagcgcgtccgtttatatcaccgtatggacaaggaacagaatggaatctgggcagaccgctaaatactccatataattgggaggattggtatggccgacatttctgtgaccaaagtgaacgaagtccgtatgcgtgtgcatgctgacgcagggatctatgaagaactgaatgattatttcaaatttgaagatcccaactttcagcctaatcctttcagcaaatgggatggcgtcgtccgtttatttaccaaatcttccgggttgatcgacatcggtcttctgtttgaactcttcaaattttgtaagaccaacggttattcacttgacgtggatcctgtattgaaatatatccaggacatccctgataatgaaatccatgatttctgtaataatttgaaaacacaaattcgcacagaatctggggaatacattgatgctgaagttcgacagtatcaattcgattccatcgccactgccatgaggcaatctcgctgcgtcctcgagctggctacaagtgccggtaaatcctttattctttatgtgatggcccgttactacagggaaaggcgagaagcgctcgaaagtaatctgaggacgcttatcgttgttccttctgtgcatcttgtcagacaattgtacgagaacttcgaagaatacagtcatggacaatcctggaacccgttctaccaggtacaaaccatatgcgaaggc

SEQ ID NO: 712 - DNA, 3965 bp, Klebsiella bacteriophage F134/15
cacataccatccaaaccgtattgagcgatcaattcttcaacgatccgttgctctggctttggccagtctttattgatatccattatgctgttgatcatacatggtatccaaaacagctcgaaggagccatagacacgctctgcaaaggaccttggggtttccccatcatagatgttatacggcaggagaagcccttcgatgtccttaatcttctgtatgatcatcacacggcgcgataggttctgtaataaaacctgatcatcctgctgacaatcaattagctgatgccagacgagggggaatttctcaaagaatttcataatcgtctcctggattagaagctgtcgccttcggtatcaaagcggcctttgtgcagaggttccagttcgataaatgtcatatcaatttgggtagacacgatgctatcatctttgtggactgcatacgacgaatccggggtttcgttgacgaacatgtttgacagaacgcatgtcgaaatccggtgcaaccatttgttgcgttcaccttgcaccatgaatgtgatatcaaatgtcgacgggtgcaggtaaaacgcgctggagttcttgttgtatttgtattcaggatacatatgcatcttgaacagacgaatgatctctctgaccattttggcttctttctgagagcgcggtgtgaatttgaaagtgaatgggatttcacggtttcgcactccctggaagatcatttccacgtatggattcgtcatagtgccggtgaacaactccagagtgtcatgagcgttaatcgtcggaaggaacgggatagactctgaagctgattggatagccttcgtggccgcaaaccgacccatttccttaccaacgttgagagcatcaccaagtttgaactggctcatatcctgggcggcgcgggaaaggaattgggcacccataccagcgagacccaactcagagccgttccagccgacgccatagttggttgtaatggattcgggcatacacaagacgatggactcgttagaacgcacgtgacgcgcccaggcatatttgctgatagatcctgacttggcaccatacacgacaggggtattacccagcgggttctggataggattctgaactgtctgtgtcgctgtactcccataagaggaaccagagatcctgttgatgttgaaaagaacataatggccaagggttttacccccggtaatatccagcggatagaccaattgtttctgggcctgtgtcaagcctttggtgttcagaactttgatcttatccagggtagacttgaaattcgccatggtcttcagcccttaattagaaatagaatgttgacactatttaggactcaattatggctatgtatcttcaggggaaatatcgcccccgtaaatcccaagaaatacaaaggtgacattcataaaattgttttccggtcttctctagaactggtggcattcaaattttgtgatacaaaccaggctattgtctattggtcatccgaagaaactgtcatcccttatatttcaccagttgatggtcgaccgcatcgctattttatggatttgaaagtatggaccagatcacccaatagtgaagaactcaaagtcacattgattgagatcaagcccaaagaccaaatcaaggaaccgaagaaaacgaagacaatgaaggaatcaaccttcaataattctatgcggacttatctggtcaatcaggctaaatggacagcaacccgagagcattgtgcaaagatgggttggtcatttattatctggacggaagagcaccttgttcctggggaagatcctgatgtcaagaagcaatttgctctcaggtctaaaataaaaagagaaaaggaaatacaagatcggcggcgggaagagaacatcagggctctgaaagaacaaatgaaaaagaccatcaaatcgaacgaaccaaaggaacgtgatgatggtctcttgttgccttaacttatgatcagctatgcccgggagctatgcattttaatttattcgcgactgatataccaaccatccttccgggcttctttagcacattcagcatatgtctcacccccatatattttgggatacgatgtgctgtattgggaagatctgtattgagtgcagtcagcacaatcgcaataaagttccaatgaataaccagacacgatcataatcagttatccagttggtcgtaaatcacgcgacggaaatcattacccttggcacagcccttggcaacaagacgagtgccgccagtaccaatgacgctgatcgttgaaaaccgcaggacgcgcccggtgatggactggtcgacctttacggtttcaactttacccaaacggagttcatctgcatcacgacggataaaccctgttttgaagataacgcgcttgttggtgacggcaaattcagtcgtcaggttccgaatgaccgtgggaatcaggaaaaacaggctgataccaaaagtcggaacgaggaatacagccacccagaaatagacccaaaatccactccaccaggtcgggcgggtaaagccaatcacgtgttcgttctggccgagcatacgatctacataacgcattttgttttccttatttgtcggggtttacgtcaaaagggagttgtggtcagctcgcctttatcattaaaactgtatttcagaatggcaaattggtcaaccatacgatagacttcaatgccggcattcatcatttctacgataccagtggtgatcctgtacggttcacagtagatcactttatcgatcttgccgctggcaataatacgtttggtgcactcagggcaaggactgtgagtgacgaacataaccaggccacaccaatctaccgcatgttgaggtaaacggttcagagcattttctcggcgtgaataacaccgtcagataccagctggccgtctacttctatttcgcacacattaggagcgccgggtgcagtaccgttccagcctatagacagcggctgatcaacccgaggatctacgataacacaaccaacctggagacggcgggcataactggccttgccatatgcctgggctgctctcatatgagcaaacatcatgcgcggcttaatcatggacattgacctcttgtgagaacatgaagatcaggtcttcaccgtcaaacttgcatgaaaccgccagggatgcgacccagctatgaacgatattgctgatgacggttcgcatttcgtctttcagtgtatcattgacttcgcggcctgcgaatttctcaagcgcggtggttatgacattatcggcatgaggataatgattgacataacgcatcagatatttctcacgaagaacgattttgtccgtaaggtcagacaactccgcagcttcttctgaataaaggcgttctttggccttcaattctaacacacgttcatacaactcttttagcggcaacataatggtatctcctgatgaattaaggagagtatatactctcctttttcaatacgctttcaaatttagttcaggcagatttctcgccccagcgcagtcaggcgatagaactggatcacctccccacgagcatagcgataattgccgtcaggggcgtcatgaccgccatcatgggttacagtaaaccaaggctcaatcaaccctttcttgagcagagactccccggtttgtgtatcccacggatcacccaggacattagtcagatgccggctcggggtaaaattccaaacgcggacacctttagaatttttccaggatttggcataacgtttggaattgataataagccggttgctgtcttcggatttcagcataccgaacatataattcaattgatggcccgtatagcgaggccacttttgagttttcacaacagtatctttcgctttcataatgattccccattgtgcagctgtaacagttcttcaaacgtagccgggcggacgtaaatgactcccagctt

SEQ ID NO: 713 - DNA, 3852 bp, Klebsiella bacteriophage F134/15
aaaccatatgcgaggcgcaacccgtaatattgacaagcctatcacaatttccacatggcaaggcatacaagaccagccaaaggattggtttcatcagtttggtgacatcattgttgacgaagttcatacttcaaagtcagataaactttcatatatcctcaacaactgcataaatgctgaccagcgccttggggtgactggtactttggcgaatactaaggttgctgggttgcaggtggtatcccatttggtgcctatcacaagatcatcacggctcgagaactgatcagtatgggatatgcagctgacattaaaatccggatgatagaattgaaacacagattggccgacgctattgatatgcatggtgccgattatcagaaagaaatggaatatttgatatcgaacgaagttagaaaccggcttatcgccaagatggctttaacattgaagggtaacgtcgccatcatgttcgaacgtattgatgcgcatatgatgatcgtgtacgacatcctcaaagaaataaagcccaacgtatttgtcatcaacggggaagtcaaatcagcagaccgcatgcaaatacaaagggcgatagaagaaggtgaggatattactctgttggcatcttatggaacgatgcaacaaggggtttctataaagaaacttcaccatctggtattggcacacccaagcaaatcatatattcgtgttatccagactctgggaagattgatgcgtcagcactcaaacaaaagacgtggcactcatatgggatttggtagacaatttgagttataatgggagttacaatcatgcgttacgtcactctcacgagcgatacaaattctatttgacagagcgccaccctgtagaattgaaaagagtggcgctggaagattatttggggtcttgatccacataggcgggcgttggctcgccttcttcactgtcgtcaaccaaacccaggaatgcgtcgatactatcacaacaacgttgtaacagttccggcttgatggttttgttgatgatcgcctgatttttgttgatcagagggaacacttttaattcgccgaagttgctcatattgacgatcgcaacataaagtcctggcttggtattacccgacaggaatgagaatgggacttccttggcagtgtctgatttcgtttcatcaactaaaattttcaaaagagtagtggttgttgtctcactgcccaatttccggcttgccatatctccgtggctgtaccctacggcatagattgctactagttgtttcatgctattcttctcgtgttgtttacatccttatataatagtctcatgttatgtttagaccaatttaaaataatttgccttttggtattaaaaagtacctttcttgttgaacaaatccgtcgtactatacgagttgtgagctttgcgagcaacgagtattaggggtttacgagcgaagcgagttgattaatataaattaatagattaatctatttcgttaataatttgcgcgcgaagagatttaacacttgttctatatccccaaatgggcgatactaaattgcgtcaacaacatgacttgacttcactatatcttgaggatacataaatgcaagaaattactctgtcggaacgcactctgcaacttctggctaactttgaaaccatctgtccgtctatcgtcctgacacctggcaaaaagctgcgtaccgtaaatgacgcatcgacggttatcgccatcgccgatatcgacgaagacttcccgttcgaattcccgatcctcgacctgaccaagctgctggccatccagcgcctgccgagtttcaagagcggtaagatcgaaatgtacgaagatcacgtgctgctcaaaggcgaaaactctcaactgcaattctggcgctcggccaaagaactgacgactgttccggctgataccatcgatctgccgtcggttgatttcgaagcaactgtatcgccggaaaaaatgaaagagctgatccgcgcgtgttctaccctgggccacaaaactgtccgcatggtcgccagcggcggcaaaacccgtctggtgggtactactccggcaatcgacaattccaacgattacaccgttgaattgggcgaaactgcgctgggtgatttctccatgccgatcgacgttgtcaacctgaaaatgatcgaaggcaactatactatccgcgcctgcactgaaatgcagctggtcaatttccaatcggtcgacggcaccatcaactattacgtcggcatgcagctggaataatcttcaatatctatctgttgctttaatatcgttgcaggggctttgtgcccctgtattttgtaaacgcatcatctaaagaggctgtaatgtctaatatcacaatcgttggtgaccaatacgcagtgggaaaacaaatatcgcccggataatctggatgagatcgtactccctcgggacgtccgtgccaagatccatggctatatcactggtggcaatggcaacatcccgtcaatgctgttctactcaccgaaaccgggtactggtaagaccacgactgctctagcggtttgtaatgaaatcggctgcgtcaagccgctgatgatcaacgcatccctggacaacaacatcgacaccatccgcgacaaagttatccagtattcgactggcgtcagcgtatatggcggacggaaagtcgttatcctggatgaagccgagcgcctgtctatggccgctcaggaatcgttgaaaggtattatcgagaaggtgagcaaaaactagctcgtttatcctcaccaccaactccaaatcccgtctgaacgaaccgctggtttcccgctgtcgtgaaatcgacttcatctggaccgacaaagaagcacatgaagtacagctacagttcatgcggcgctgtgctgaaatccttgctgctgaaaacgtcgaagtcgatctgaaagtcctcggccggatcattcctcagttcttcccggacaaccgtaagatcatgggcatcttgcaagacaatgcctccacctatggaaaaattgatgaacgcgctttggccgtcgttaacgcaggcggtatgcgccagctggttgaagagatgaagcgtaacaactgggacggcgttcgccaatgggtgactgataatcagaactacatcggcgatgatttctattcccgtttcttccatttctgtgtgccgcaggataaggacaagccacgggctatcgaaacgactagcatcgtcgatatggtcgctctctgcgggcaggcgcagattgaacacagacaggctggtgacgtttggctgcatgcggtttatttcctgaccaacgtcatgctcaacattaagtggagctgattatggccgctccgtctttgttcgatttcctgggtgcgttgaacaacaccaaagagaacctcttgcaaacggacgaccctgatgttcgtaaggcttttgatccgtttatgactcggcgcgggctggcacagaacaaagatactcttgtcatcgcccagcgaatgaatttgcttcacaaggtcacgccgtggatgcaatggaatatggcattccattctatcccggcccgcaagcggtatgggaagtgggccaaaaaaggtaccgctcgaccctgatattcagatgttgtctgaatattattacattagccatgaaaaggcatcagagtatctcaaatttcttccaaaagaaagcactggccgagatcaggaagaaagttgagttgtctaacagcaacgagaaagcgaagccgcgcaaggctaagtagttaaaatacattaatgaaggagtttggtcatggcgcgcaatacgctcgacatcttaaaactagactgcggtc

SEQ ID NO: 714 - DNA, 3639 bp, Klebsiella bacteriophage F134/15
gccaatccacggtgcccaaaagacagccacctgcggaataccgttttcttcaaactttactttatactggtcgtcaaagttatagaatatttcttcgtcatcaggagacatcccaatctcactcaagacacgcttcagttctttagccgccccaacagaggaaggattctcttgagaacggatgtagttgttgatatgaatgatgacgccatccatatcactatcccctgatcgtttgtcagggcattctaccactttcagcaattcgttagacacttcagactccttgacggacaaattggtaatgtgcaaccaggcggtcaacgacttctgtaaaattctcacgcagatagtcgaagtggttgcggccttctaccggtttaacatatatcatattttctgaatccgaaagatccagtttttcataattcccctgaggaacgaagatgctgaaaatattgttccagatacacgggtcgacatatttcggattgtcgtcaatcaaaacatcgccagcaaccatgtgcttttcatccgtgctgataaacccgttgaaaatgttcgggaacttgccatacacgaactgacgtttgctgcgttcgtgctcaggttcacatttggtgacagcaacaaattccaccatttcaaacttcatgagaagcgcatcatgcaagttgttcaagaactctaccgcaccgggcaacggctgcatacgggagtacagatcaggttggcgccaaaagtccatcgggtcgcgtccgtttgacatataatgggtcttaccgccgatactgacatatgaatgtgaccatgccggatgagcacgttcacgcatcaggattgccaaatcacccgcatggttcatataacattgcttggtgatcggctggaatttagcagggccaacaatcccgtccgggagacttgcttgggcttccaggtttccgtcattaaaccatttgacccaaggcgatagactatcgaccattgtcagatcaacgtccaccaaaacccggtacaggcctccgacctttgagttcatatcgtataggcaagtcaggttgttcatttatcttcctccactttatcatatcctgtcgctttacaaccatcagcctgacagtcgccatacaggacaaccatggagtcttttacgaaagtagaacaatgatatagctccgtcgttggatcgctgtcatcgtaattgcaaacggtctggatcgggccgggagtagtaccctggagggcggcgtgtgctttaaccatgtcatccattttggcctgagcctggtcttgggtgaagtccggcccgctgagatctggtgtgtccaagagagcagagcaagcagacagagatactgacagagtgaatgccagcatgattttgtagaacagaacgtttttattgagtttcatcttaatcacctattctttgtcaaagggaaacaacaaggggaattatatccccctgtcggttattgaattagtgagaagccaaagaattattgtggtctaccataaattggtagttgccaccaaattttttgaccgcatcaatctcatattgtccccattgaaattgataacgctggaacaatttttccggcttaacttcaatctccctctcaaagaagcaatcgtagcaaagcactttcccttcttcggtgaaagattttgctatcaaaagcgtcacgtccgggccgggtcctccaaacacaaacaggtatggatttcctaaaaccacttcattaccacgttgatcaacaatcattttctacccctttttaccccatcattgctaacaaattgacgcgccgtttgtgagaccagccaacgaccgtcagtatagactggatcggttcgatgaatgacttctcaaatgccgtgttgtaatccacccattttgccatatccaattcttcggggaagaactctggataggcgaaatagttctgaccgaacggattaccagctttcagcagaacaatgttgactttatcaccagattctattaacggtaaatcgagttcttcatgcttctctaccaggcggttgtagccgacgcatgccttcgcagcaaagtgcgccccagagataaaggatccgtcaggagccacgcacttctcgatgtcagatacacccgatgccttcgcaatgtcatcgacgctcagtttcatgtactcatctttatacgtcttgatgaggtcttggacttcgctttccgtgacctaaaagaatgcgctcatagcacttgatgagacgttcacgacaccattctggcgttgttgatttacgcgcctcaagacctttgaatttgatcttcggcttctcatatttgatgccttcactgtcatagacagccatgcaatacatcttcttggcacgccatactgcagcagacgcaatgacttcacgctcccaaaccatgcgctgctcatagccattcatcgtattacacagcatctgtgcccattcattggtcttgggctggtaattctccttgatccattggtcgatattatcaacaagtttgtggtggtcagtttctccttcccacaatttcttgaccaggcgctcaatacagatatagttcgagtccgtatcccccgcgataacataatccaggccgctggtcccgcacaatccgttaagataatcgtcagtgtaacgcttgttccacttattgatcaactgccctgaagttgtaatcgcttccgcaatgttgaggttaaagtattctttaaaccagacgttagagattgcaccataacctgcgttcatcaagatcttcagaccttgctgtaacgtgtcttgggcaacgccaaggtcttcccatttgtgcatcacttcggacaggtggtcaaggtcgatgttcttgtgctcttcataccagtcttggtcaaagtagcgggatttcatcgcggattcaaggtggaagtcacccttagacatttccttacaccagcccgcccattgctcatacttcagacccttggccttctcacctttacggtcagcgtaaataccgcgcatgatctcagagaggaaggactattttctcattactgaagaactgaacgttcggtgtaaacgacacgttgtaacgcacgagggtttcaaaccggaattcacccagggcaaccagttcatccacaacctgtaggcgttcatcaatcgcgcggagcagtttgtcatgaagattcttcatatggcgacgtttatgcatcggcgtcatcatatcgttcatcttagcagcaagctcttcacacatggcttcaatgatttcacgacgggtgtgtttatcgccgataatcgtttcaggcccaaggttgtactgctgaatgatgtgtgggtacagggagttcaagtcctctgagaagacccaataatagatccctggcgccacttccatgacatatgcgccttcaaagtttgtcggcccatcatagacgcgctggactttgggtaacaatccccttttcgtacagcttgtaataacacatggccaaccacggggctaccgtgcccaagccgtcttcaaagttagatttggtgcgatacgctagaacaaacatcagctgaatgagacgcagcttttgttccagacgccagacgagtttgtacgtccttaataccata

SEQ ID NO: 715 - DNA, 3366 bp, Klebsiella bacteriophage F134/15
ctccaacgatcaataccaccgtcatacagaaccgtgacagggagtttggctttctctttaacatggcgacctttcatgatgccgatattgaagttccaccccagcaggtctttgtcttcttttacctgggaacgggtgataaaccaaatcaggttagatgataggaatccctgcttaccgcctttgatgttaggctcagcatattggttcccgatttcatcataatacgaattgatccagaccaacaccagctctttgctgttgatctcgggtgtaatgacgcgccagaagctgttcagggcgcgggcgcgggtcatgtcctgggtatctttgccagcgatggcgtcttctacctctttggtggaaggtaactggctgatagagtcgatgaacacgattactttatcgcctttcttcacttcctgaagaatctgcaacagacggatcttggtctgttcaacgttatcgatcgggacatacagaacacggtccatgtcaatgcccatggatgtccagtagtctgcgttggcacccttttcagaatcggcgaatacacagatcgcgtcggggaatttatccatgtacgctttgacgtcaaccaggccgaacatcgttttgaatgtacgagaatcaccgaccatcattttgatgccagagatcagaccgccatcaacacgcccggaccaggcgatatcaataaggggaataccagtcgagcagataattttcgggtccagcgcgtctgactgagataataccgaagcctgatcgtcatgtttcttagcaactttcaacatgcgatccattaatgaactggccattttacttcctcttgtttgttaattgtggttaataattctgcacccagaaccttcttagacaaaatattaatcgcttcctgcatcgttttgatggataataatgaatcttcatccaattggttctggttatcatacaggaaatgattgcgtaaacgatagttatcgcgccgaacgatacacccaaagttgatgttatgattaatcagacgaacaatatcagcctggctaacatctttgggcatggtatggagtgaataaatcgtctcactgaaatagatatcctgcaacggcgctggaacaggaatgtcctccgatgcccagcgctcaatcaagacgaatgcttcaggttggggaaggtgttgtaaataacatctccgcaaccccgccttcgacgtctaacttacaattgagcaccacatgcccaaggggtttcatgtgctcaatgaaattactgaccgaggtctgaagattctcggccgagatggagatgttaatcgtaaacattagaactccagggtcagagggatttctgtggacttgtcgtagtcagcgccgcccgcagcgcgcagccgattacgatcatttttgtcgtttgtgcgccagcatgtaggtctcaatgtcgatctccatataagaacacgcagacgacaggaaaaacatgagagtctcaacacaagggtcatccatgaactgcccaagacggtacgtcacaccccgatgtccaacagcacccaaagcaaatggagtgaattctcggctatcaagaatttcaaattcttcttcgatctcgcctttggtgcggtccaatagaacgaagcacaacatgaaatgaaccacgtcgaccagttcataaactgcgttcgtatggtgaaacccgatgtcattaccgtaaaccttccaatcagcagtcgtttcatcgaggaattctgcccattcacgataaatagagttgacgactgcgttttggctccatacgtttttccactcttccccaaagtaggccacgttagtggccttttggagttcgagcagatttttaatatgatctgctgttatcattttctgttcctgtagaattcaacaaaattgttacggccttcaaagttgttgacatagtcataatcaacaaccatttggtcgatataggcctcaacgtcgtcctctactataccagaacgattgggctttgaaatgcgcgtaatggggcatttagtactcagcgcccaattatattcctgcggagtacgcaggtcgctcacgatatagtgcacaccagggttagcctccacgagaggcaactggaagcgtttaaagaacgccaggaacagatcgggttgtacatagcgcaaaccgcccttatcgttgcccagatggagccagatctgccttggcgacaggttatgtacattgtccggatgtgagaacggtagatccttgatggaatcgtctacgtcaaccgggagccaagggtaaatgtaattggccacccggcgcaactcatcagagaaagaaagacgatgaacgacacggataccccggtctgcttcaataatggactccaggcagaagtccttaccggagcgcttgcgccccgtgaagaattccagattagggtacatcatttgtcaccacccaaagaacgaggattcatatatttgcgatcaacaggagaatggcggagagcattcagtaacccatcatcagcaatatacatatggttgataagaacaccgttcaaacggcaccacaaacaatacgccatttgcatcaacaaccctctgtccgcgccatagcgttccaacatccccaatacagaaggccaggataacccgctttcacacgcttccaacacgtcacggaacatatacaggattccattctgctcttcaacaatttcattattgaaaataatcttgtctttgaacattccttcttccaccacgacggtatccgccgtgattttactcagctgtttttggcttacttcattgttgtaataatgaagattgttggagaacaacttgtactggccgacattaacgcccaaaacattagcgatcacttcttgaagaatagagaattcaatgaagttaatcgaagacattccccaaagaacatcctggctacggttgatgacagtcatgttcagacagccgtttgtaatagagaacaaaagagccaaattacagatcatgtccttggtcttggcttcgcctgtttcattatgagcggccaaaccttcatcagagtccagcgccgggtcgtagattgtcagataagcctggcgggtatttggattcttgcgcagacggttgataacgctatccagctgcccgtgattgtacaggcgtgggccatacgcgccgcgccaggttacgccatcgtcagagaagttggccgcgcgggggagtactcgggaaaggaaacggatgtcattgcggcctgacagaacccagaaggtctcgccaatagcagccagcgcagaagaattgcgaccttcaacggaaagccagcggtcacggatgtccgagacggttatggtcac

SEQ ID NO: 716 - DNA, 3096 bp, Klebsiella bacteriophage F134/15
ctgatagatggagatatcgtcttcctttggatacaggctgacttcacgggcggcatcacatggattatatttcccgtttcccagccaccagtctacagtcactttctctttgacacgaccgaggtcgatttgctctttgacattcaatttaatgaatgtggtacgttcttcgactagttgctggagagtataacgtttggtcaaatcagctactgtctgcgcccaggataacataacagcatcatcccagcggcccagggtttcactatcggcgaccgccaaaatacttgatttatacatcagatttctccattagattaaccataaccaccgtgtccgtcatcatgatcattatctgagcagtggatagcaatccccagaccgatgaacaaacatattatcgaaaatacgcctattgccattaagatcttaccttcttaaagagaaattcgatagaattaaactctttgtcttcagaattctcgacgaccagataggaattatcaccctggcggaagttccgatgagggaaatattccccatcatcatcccaaccgccaccgacgcggaattgtttgagttgaccacaagctgcatataacttgataggagcacgaacgtaccgctccagccatatccaattaccgtcatgcaaacgtgttggacaaaaatgcgaaccgcttagaaggatacaaagcggccttggcaagcatcttctccgtgacttccgggcgacgtaatttaatcaacattggaaccttccacttggataatttcttcttcagaatcgacgacgttgatatcatcatccagcgcgttcagattttccatgtcttccgcaaacttgtctacttccatgatgtagaacacggggacaacccggcggcgagtgtcttcgtacagggtttctgccagcgcttccacctggcggacaacgtcataaagattaagaccgccaataccacagccgatagctggcaggccgatatagaccgtttcagaatccttcgcttccataatctcgtgaagttgttcaaacatcacttgtacagaactgataacggaaggcatacgagcatttgggcctgtatagaattgagtatacagattgaagccccaaacacccgtgtcacggtcaaaggcataagacatgccaccgagacgctgctccggcccgcgctcatcgttctggtctgcgcgccagacgtcaggaaaccccagtcgaacgaaattggcgatacccgcgcccattaccgaccagcaattggcgccatgggcgaatccgttaataagattgaaacttttcgcggcttccaacaaattcccaccacgaacgatatacgttgtcatataattcttctccaggtaatgttgatgtcatcaataaattcaaggcaaaaaacgaccgccatgtccttcactattgttgacggacatgatagatgttctctcgtcggtggcgataagattaaccccaaaccctttggacatcaaacggaaagcgatttcttttgcgatccgattgagatacgcaggggtggttgccggatcaaaatatttttcgtaactcaggcatcaccaattccccttcatcacgctttccattgcgttttcagaaatatattcgatgaaatcattgtcggacgccatcttcaacaactcgaataattcaccaccgacggcgcaaccaaacatcccttctaacattcccttcacgttttcatcgatttcttctgggtttaattcatataatttcaagcgacgtgaaatagcccgaaattgcgcgatatcaccgggttcaaatttggccatggtcatttaccagttatgggattaggcggtaataataccgcctttttattcaataaaggtcttcggagaaaagctgattgaaaggagtattcttcagacgaacttggttgacttgcccggcttctttagcgacgatcgctgcctcctcgcgagttaagaaattgccttggttgtcgataaaaccctgttcacggctatgggttgtggtaatgaccccggcttcttttagaattcttaactgggaattcatgaatcggctgtggtgacgatcagcaaccacgatcacgtcaccatatttgttggctgcggccacgacacggcgctgccattccccttccttgggtaggtcacgagcgtacagggcaaccattgtaccatccggggttcctttgacctcagagaacaatcgtccattgccaccagggagttcacggaaataaccaagtagtttcataatctattcaatccatatttcaggttcaggaatatcgaccatatccacagtctggtttttcagatcgtgaaaacagtcgccaagaaattgtattttgccatttgtcaagaacaaatgacagcgtgagcctgggcgatctttaaacaccaatagacttggagtaaaagtgggtgcaacaacatcattgttccacgcccagaccgggccttgttctggagaacccttcacgcgatatgggtgaagcatattacaaccaggacattgaaaatataaagaatcacccatagacaataattttgaactcaggaatctgctcatcagctgtccatctcctcatatggattgtaagggcgcaattccccgatcagtttaggcaacaaggcgaagccgaacagattgaaggaacgcatagtgcctaccatgacaacatcatcgtcttcgtcagtgatatctttcaaagaacatatggggacataggcatcgaagtcttctccttccccttcttctacaagggcgaatgcgacttcttctgatatgaagcgagggatgcatatgtcaagcacccaggcaaggaatacaagaacggaaatgctgcggaaatagaacatattaaagccctcgcaggtggcgggggcttttggccccctgtattatagatcgagcagagtttccaactcgtctagatcttcgttgtaaagatctatgtcctgtttcttatttaactcgtcccgttgaatttccagattcttgatctgatttaacaggcgctcgcgggcgtccaatgtaatcgaggatagagacatcttagaacaaatcgtcaagatcaccat

SEQ ID NO: 717 - DNA, 3059 bp, Klebsiella bacteriophage F134/15
cgctcccggattcaaactttccgctgatggttctcgttgtgaagtcatgaacgccagcgagcgccgttcccgtaaactgggcaaccggaaagccatacgcgaccaaaaaacgtatgggtctggggtatgaacgcaaagtcgagcggcgtaaaaagaaagccatgaagttccgtaaaatgatgggactgagtaagtaaggagcaaatgatgaaactgttgcgtgagatcacggcgataggaaaggaacttcagatcggggaagcgcaaacttccactggtgggaaggccatgttcatcgaaggtccgtttgtgatgtgtaaccaggttaaccgcaacgggcgcaactacgaccttgaaaaagtcggtcgccctgctgtggaagcatatgaccgggaatacattcaagatcgtcgcgcaatcggtgaactcaagcatcctgactatccatttcctgatatcgaacatgccgccctcaaaaccgagtcactcgtgtggcaaggcaacaatgcaatcgggcgggcgcgtattttaaacacccccaaaggtcagatcatccgtgctctggctgatgcggacttcaacctggctgtctctacacgtggcctgggtgagacagtagaagttaacggctatgatgatgtcaagccgggcttcatgcttaccgctgttgatgctgtcgaccgtccttctggacaagtttgttatgtaaaagacggttcacgaatctgtagactggcaacttgatgaatcctctggtatctggatgccacgggacatcaaaggtcaggttgtagacaatctggttaaacacaatagccagcttgaagacgacttcctgcgccgtcttgatttagctcttaaaaaattagggttgatttcagctcactaaatactgaaaaatacgttcagaaggaaattatcatgaaacctgaattacaaaaactgtttgagggcgttaatggcctcagcaccgagttcctggacaaagtgagcggtctgatggaggctaaagtcggcgaagcccgtcttcaggctatccaagagactgaacatgttgcccaccaggaacgtctgaaactcgtggaagcgcatcagcaagaaatcgctaacctgaaagaaactcatattcaggaagtggcgaccaaagttgatgcattcctgaatgccgtggtcgaagaatgggcgaacaaaaatgctccggctattgacgctaccatcaaaaccgaagcggctgaaaaattcctgtctggtatggtcaacgtgctgaaagaagccaacgttgaatttactgtagacaccgacggccagatcgcggcgctgactcatcgtctggcggaagcagaaaaacgtgcaaacgtttctgaatccgagctgaaacagatccgcgaacaagaaagtatccgccagcgcaataacgttattgacgaaatttgcgaaggcatggtcagtaccaaaaaagaagtcgttgttggccttctggaaggtattcaattttctgacgcctcttccttcggcgctcgcgtccgcaccttccgcaacctggtagaaggtaacaaagacgactttactgacaaagtcggtaaagacaacgaaggcggtaaatcttctgatgataaggaaaaagacatcaaagaaggtaaaaaacagaaaaaagaaggcgacgatcctgatgatgacgacaacgacaacgacgatgaccctgatgaaaccgacaaagaactgaaagagtcggtcagccgtcagctggaagaataccgtcgtatgcgtggtctgaaaggctaaattttgcagccacagccctctaaaaagggggcttgattttgaacgactaagtaatttcaacttaactgaatatcaatgtaaggaatgagcatcatggctaagaaacttgttactgaacaaatgcgcgaaacgtggctgccggttctgaatgaagaatccaaatctattcagccgctgtctgccgaaaacgtcgcggttcgcctgctgcagaaccaggccgaatggaacgccaaaaacctgggcgaatccgaagcgccgggttctctgaacaccactgtcggtaaatggcaaccggttctgatcgatatggcaaaacgtctggcgccgatcaacatcgcgatggacttcttcggcgttcagccgctgtctggtccggacggtcagatcttcgcactgcgtgctcgccagggcgttgctgacggttctaacacccagcagtcccgtaaagaactgttcatgcaggaagccgattccggttattctggtgacggtactgtacaggctggcgacccgtctggcttcacccaggctgagatcgaaggttccggcgctggcaccaccaccatcggtaaaggtatgccgtcgaccgacgctgaactgctgggctctccgtccaatccgtgggcgcgtgttggtatcaccgttacaaaaagcgaccgttactgcgaaatctcgcggcctgtacgctgattacagccacgaactgcgccaggacatgatggcgatccacggcgaagacgtggacaacattctgtccgacgtgatggtaactgaaattcaggcggaaatgaaccgcgaattcatccgcaccatgaacttcagcgcagtgcgtttacaaaaaattcggcaccaacggtatcgtagacatcgctcaggatatctccggtcgttgggcgctaggaaaaatggaaattcctgaccttcatcctggaagttgaagcgaacggtatcggcgttgacacccgtcgtggtaaaggcaaccgtgtcctgtgttccccgaacgtagcatccgcgctggcaatgtccggcatgctggattacgctccggttctgcaggaaaacaccaagctggcggttgacccgactggtcagacctttgcgggcgttctgtccaacggtatgcgcgtctatatcgacccgtatgcagtagcagaatatatcaccctggcgtacaaaggcgcaactgcgctggatgctggtatcttcttcgcaccttacgtgccgctggaaatgtaccgcacccagggtgaaagcaccttcgcaccgcgtatggcgtt

SEQ ID NO: 718 - DNA, 2979 bp, Klebsiella bacteriophage F134/15
gtggtcatataggaaaatattgttcggccaatttctggatttcttctataggtatttctctgcgaagagtatccagcgctttggcatgctggttaaatgctgtcacttgatttctcctttgggggtgtcagtatagtttacccgaatcccaagacgaaaaagccggggtaatccccggcttcctctttgtacctgcctgcgcatagcgcctggtactggccgaatttgttttatttgccgttggcgacgtttttcagagtttcgccgaccttgaatttgacgacatttttcgcttcgatggtcagcgcagtcccggtcagcgggttgcggccagcgcgggcttcctgatgtttcacttcgaaggtgccgaatccgacgagttgaacggattggccagcagcgacggcagagttgataccagcgataaaggacgcgacagttttttcagcttcggttttggtcacaccctgagtttgggcgatatgtgcgataaaatcttgacgattcattcggattactccagttggtttatgttaaatgtttacttctgtgttcactacaagaggattacagcttacctaacaaaaattaattgaataaagcacttatttgccgattcccaataaattattggttcagagccgaactcactatgacggcataaatatctctttctatacgaccatcacaaaatccttcctggaataagcctgcgatagcatccaaacatttctgagtgggttctaccgggataacgactgtttgtgggtcattgacaggccgggggaagtttaatcagctggccgacgcaaattttgtttggatcaatgatattgttgtacttcgctatatctgaatacatgtatggatctgaataaaatttcatacagatccccataagggtatcacccttttgaacgatatatgaactgatcatggtcatgattttatttcccaaccagtagaacggaggtgatccagataatcctgcagatcttggtcatcctcgatatccacccaacgatcttcaaggcccatttcgatcaattcggcatcatttaggtcgtgttgataaatctgaataccgctggcattgcaataatcaggcttgatgttgttctcatactggaacaaatcataatcagctagcgccgatttcaaacgttcagcttcagcatacgtcggaacttcaactgtaaacattttcccgggaacctgaggaacgtgccaaacgcggaattttagatacaaaaatacggctgctcatgtttactcctgattagttgtaattcagaccgtgaaagaagtcgaagaccgtcactttcttgcgcggcgatctcatcagtcaatttgttgaaattaacaaggtgccccaagtctttccaacgttggaagaactggtgctccagggtagataagtcatcaatacccatacctttatctgctggcagcagcacgaagaaagaacgttgggattgactagcggcgatatgaaccagatagacatcaaatagcatgctcataacgcactccaacccattaaatcttcaacaatctcgactttatgggatttcagaatttcatcaatcgttttctgccccatgtaagagaacggggtgcgctggtagaatgcccacagaactaattgaacaacagcacgggaacgggtttcagcccacatttccatatcactaaaatgtggggactgcgctttccattggatctcttcacccaggtcctggttgcaggttacagaaatgcggaatttgttgcacagggtatcaacttctttgtatgcgtctgtggagacacgaagttgttcggcatgcgcccaaggagttgtgatgatcctttcacccaagatcttgtcagaaatgaaccaatctatagactggctaaattcagaaaaatgatcaatacgataaatacaatctcgcccctccatagaacgcatggcatgataacgagcgtctatttcgttgttgtgcattgcattaaattcaatgtaaatgcgccgggccaacacgacgtcttctggcgccagagggaccatcgtagtgtcgttcaccgtatagtggaggaggcctgtaccacgcccatgatcgtgttcacaatatacatatcgagatcccccggcgcgggcataggcgatatatgagggttcagataaatgcaggtgcccttgatcggccccgataatgatcggatagagttttgtacattgtgcataatatattccttcaaatcaaagaggcggtcattataaccgccccgatattatagactgccgataaatgcgttcttttcttggtcccagtccatatagattcgaactgtaccggaatcttctgggaacttgagatacttcggcagacctttgtgagagtaattccccgatttgttcatattatacatagaaccgtttttcaccagggcaatgaccttccgatccttagacaccagaaaatcaaaattaccatcgattttatccagaagacctttgctcaggatgattttaccatcagtccgtattgacacgaacaatggatgattgcgaggattacgttcgcgatccaattctttaaccccgataaatccagaacgccaatcagtatcctttttggctggttttgtttctacagccgttgcaggaacaacttcgactttcggttctttcggggtcggtcttggacgattggtaatcttggacatctgttctttgacataaggcggcggggagcgtttggtcggatattctttcccacccataatgccaccgagatcattaacactaacccaatgaccagcatcgctccgcttcgctaccagagaacaggagtagatgataccttgtagggtacgtggaagcatcgtgctcgcatcccagaactggctcccttgctcaaatttttcagcaaagaatacacgtccgtctttgtgcactatgatgacattagcagcatccggagacaaaacggg

SEQ ID NO: 719 - DNA, 2798 bp, Klebsiella bacteriophage F134/15
ttgacactcacaactcgaagggtacagcgttagcatacagtctagagatgtgttagaaaagtagtttctgctattaataaaacactcctgtaatttagagattaatattcaataacaatcgttctattataatgatggcgtttatttcaattctacaagaggatcttattatgcacattaacaccgcagttatgaaacacatcattcctttattaagaaaaatatgaaggacaacaagccaccaaaatttctttgacgacaattgctgaggaagttaaactcctgacaaataaaggggtaaatttccgtcgcgttattgacaatgcggtttcccttgctcgttccgatatgaaacacaacaccttttcatttaacatcgacgccacgagtgagttccgcaacgaactggaacaatcttccaccgcccgccgcgaccgcttccgtcatttatatgttcgtcccaacatgccagaatgtcgtattgggatcaaactggaagccgtccgcacggacactgcgttcacgatcaactatgttctggaaccagaaagccagcgcatctacttcgttgcgatcattggcttctacggtaatgccatcaatggctggtgtgaccgcgttaatctgggcgaaacaacgaattcacattctattccgtctacgcattatatgtcgaatgcagctgctcaggaatatgtgtttattctagagaaggttgtgaagttttctgtggtaaaataacgctttattcaatacagaattacagtaaagtaagttgcatggaagggagggaacagtatgacaatcatagcgttactccttatcctcatcatcgggatggccttcactctcctgggaacacccgatgtttactctggtaaagcgccttcgatagcgcaccgggttttgagcagaggttcgccgcaggatttcaggtcctgttgctcaagaggagaggacttttctaaattagccgtgttgtagtatcataaaattcaagggaaacagcacagtgggagtaggcttgaacccgaaaccagttaacccctagtctcaggggcttgtgtgaatagaggcagcgcagtaaccctgctggtgttggtggacgcactaaccgtcggagaacgaaactccctgttgaaagtgtgattagctcagaaaagtaaccgcaaagcggagacgagagcatcccggcggcgagtcgacaccgcacgatgggaaggtcgagggctggtaatcctcatcacaccgacaacattatgagtcttctaaagagggttcataatgttgcgtcaaagggcaacacaaaggtttcctgttggtaacataattgttcctactgtcttcccggattctaggagcgccaacaggacgaggccggatgcgtaagttccggcaaataaaaagttttgtcaataagggttaacaaagtatagttaacccactgaagcgaaaagctgtttgggcattagacaaacacttcgatgtgaacccaggacatggtgtcttgtgctcaaacaggttttcgttctcgttgtgtgcggctttgcgggtttttagaaactgaccacaaagataaatgcaaacgataatacgttcctggcagtagcttaacagccatacaccagcaaggtcttccgactccttgtcaatgaattcggcgcactaacaataggcgggagggtgtgattaataagctcccgccgactaaaacggctccatctttgagggcattccgcgtcagacgcgaaactgcatggaacttcagggggaagggcaacttaaatccgacgccggaatagcgctagtcaatatcggagcctgttgtacactgaatgccctcaaagatggaatgcaaggtaaatgcaaatcggttctcacttgtaatggctcaccaccgtgaacgtgattcaggactgagatgacatttcattgtgcaaggtttgaagacatgttgcggttcataaccctacagcctctgttcaaaactgaacacaatgtctggtgatctggcagacacccggtcttgcatgacatccacacaaatcgaagtgccttgacaatttatcttaaacccaaaggttgatctacaaagtggacggccagcccggtagatgataacaatatgttgggccacaactgttgagtcagggcacttcgatttgtgaacttgagagagcgttgggtagaaaaagaccacgccttgcagattgcgatgcctacacattccggacactggtgggcaccaagaagaactcagtagcagacgagccatcagggttagctacccggcgcggcgaggattgggaggccgaactaaggggaaacccgagacaggcgtagtattctcaagttcacaaaatgaagagcatttaaagagttcgattctctttcaggccattcgtggtgtggtgtgagtcatgaatgttcttcatctttgggtgattctatgttgccgggctatcaacccatgcttgctggagcaaccagcggctctgaatcaaccagccagcctcgtttggtccgagcgttagaggacaagttgcttctgtatagatgctgctatgtttggtgaattctgctaagcgcaagagggaacggaatagtctcatctccttgagtctgatggtttcatcacacccggccttgttttccgtggtaaggtcatcgggaggcacccgacaccaaacagcctggtctagcgaatagacaagtgcctgactttcactcaggtgcgagttgcgacattggttgcaactttgaggacactggcatccgaatatcagttatgggtgact

SEQ ID NO: 720 - DNA, 2605 bp, Klebsiella bacteriophage F134/15
gttatgtttcgtttgagattgaacgaccaagatgtgttctacaaacacttcacctttccaggcggtgaggaacatatcaagattacaaaaggcgggtatccctgttaggtaaaatccagacagtggtaattgacgcccacattaaatcgtcagcagacttcattgagctggcactgttggtgaatgccgtgcgcggcctgggtaatgtcgaccgactgacaacatttcatgcttatatcccttattttccatatcgcccgtcaggatcgtcattgcgtactttggtgaaccttctttcggtcaagtgggcagcagagttcatcaatagtatgaactttgaccgtgtggcgatcaaagaccctcacagccatgtcgtgtcttctctgatcaacaacgtccatgttgtcccgcaagattacattgctcgccagtacctgggatggttcatccgtggaaacaacgctgtgttggtagctcccgacggcggcgcggcgaagaagactgaaacactcagcctatcgctggatggcgttcctgttgtctacggacataagaaccgcgacaccaagacaggcgagatcattggggtgagtattacaaaccctgaactgatcagagaccgctatctggttgtggtagatgatatctgtgacggcgggcgaacgtttgttgagctgggcaaagagcttcagaagcacgagcctaagcacatgaccctcttcgttactcacggcattttcagcaaaggcctctctgtgttcgacgggatctacgatgctgtgtatgccgacactgtctggtgggagaacatcaccgccgacggtattccattcaaaactgaaaatacaggacgtgtaaaatgagcatgcgccacttagatccaatccatgcaatcgacttctacaaatcagggcacatctatcaattccctgaaggtagcgagctggtgttctccaacggaactccacgctccaacaaactgttcaactcccacctgccgaagaacggcgtggtggtctggggtatccagggcttcatgacctggttccacgaactgtttgatgaagcgttcttccagcgcccaaaggccaaggtgctgaagaagtattcccgtcgaatgaacaaagttctcggaccaggccgcgttgggacagagcatatcgaagccctgcacgacctcggctacctgcctatcgaagtccgcgctctacccgaaggcaccatgtgcccgtatggtgttccggtatatgtgatgttcaacaccttgccggagttctactggctgaccaactatctggagacggtgttcagctctgagatctggaagccgatgacgaacgcaaccattgccctgcattacaaggcgctgatggtgaaagccgctatcgctacgggtgtgtcgccggaccattggttcatcgactaccaagggcacgacttctccttccgtggtatgagcgggtggcatgacgcggcgtcttccggttctggccatctggtgttcttcaaaggcaccgacaccaaccctgccctggacttcgttgaagagtattatggcgcggatatcgatgaaggctatgtcgttgctggctctgttgcagccaccgaacacgccgtgatgtgcatgggcacgaaggatggcgagttcgaaaccttcgagcgcctgatctctaaagtctatccggacgggattgtcagtatcgtttctgatgcatgggattactggcaggtcattgacgactatctgccgcgcctcaaagatatcatcatggcgcgtaatggcaaagttgtgatccgtcccgactctggtgacccggtgcatatcgtcggtggttatcgcgtcgaagaattttgcaatgagcaggatttttacgataacgatccacgtgaagaaactgaagttatctatctcaaagaagaaaacagataccatattctggaacaatatcagtttaatcagatcggggaagagatttctcgttcagaagcggttggttctatccagcgtctatgggagatctttggcggaacgcagaccgaaacgggccacttcctgttggatgagcatatcggcctgatctacggtgactccattaccctgagccgtgaagatcagatctttgctcgtctggctgaacgtaatttcgcttccatcaacgtagtgttcggtatcggttcctatacttaccagatgaacacccgtgatagtaccgggacggctgtgaaagcaacggctgggaaggtcaacggtgaattccgtgagattttcaaagagccgaagactgacaaaggtggtacgaagaaatctgcgcgtggtttccttaaagtcattaaagactctcagggtaaactagtgttggttgatggtatcacctttgatcaggtgcaagatgcagataatcagcaccaactggtgtaccgtgatggtaagtttttcaatactcagactctggaagatgcgcgcgttcgtgccgctcctctggtggaagaattggcatcacaaatatgttgaataactgcaagccctgttgaaataacccgctgccctttggcgtgataatgaaccccgccttgtgcggggtttggtcgtatgaggaatgattat

SEQ ID NO: 721 - DNA, 2446 bp, Klebsiella bacteriophage F134/15
gcaggaggagaagaatcttcaaggaaatccttgaaggtcttcatattagactacagccatttcacaacgggtagaagtcactgaatggccatcggcgtcagaaacaacacaccaatattcgccttcgtcggcagcatccacagcagtcacaaccaggttagcggttgatgcagtcgcgttggtgccagcgtcaataaccgaacctgcgccacccggcacatcagagaaataccacgcataagtgtacggggtagtgccacccgcagcgacaacgctaaatgtcgcgtcttcaccacctgtcacgtctttagttgccgtcagatcggttgaaagagacaaagcgcccgcaacggtgatgacggttgaatcgacatggttaccttctacggtgacgccatagacggtaacggaaccggactgaagcagtttgaatttaccgccgccgatatggaccgctttagtcacgtcaccggaataccagttgacgcctttataggtcgcattcgccggggccaccgtcgccagaagttcaaccacctgcccaatttcaccattggcggttgccggggtgatagtcaggccagtagtcaggactgcgctgggatcgtgaatttcgtaagataccaggaagccaacgggcttcgaaggatcgattttggtcacgccgtctgcttccagattagatttggtcagcagttcatcaagacctttacattcggtcagaatttcgttcgggtcttggttcagactggttttctgccagcccttggcaaccccggtaacaacatgaccacgttcggtctccggtttgttgcgtacaacatacggcgcgactaatacattgattgttggcatggtttcctccactcatccaaatcgttgttcagagccatcatcagctcgttatctggttcataagaaccggaacataaatcatctctccatacacctaacgtcaacaacgctgctttcagacgaggatgttgggacttgtcagttttcaacaccaacattcggcataccgcctcagtctcaaatgtgttgaaaagcgtaatcaattgattgataaggactcggggacttttcccggggacaaatcgtttcaatgattgattaattagcgaaattcgctgaatgtccaccatcaaatcatctcttgagacacaaggagtaatataatgcctcagagcgtattccattaaattgctttcatcaacaataggcatatagaataagttcagctgttgtacactggacttatttaatctgtaagtttttcgatcaatttggcgatcagtttgtctcggtctgtttctacaatccccagaggctcacccaataccgacagatcattgatatccaggagattgagggtttctactgtaatatcagtgctgatgaccgtgcccggttctatcggtcgaccgaatttgtcacgaccataacgtttgagggtactggcaagcccggttagctcctccagaagctccttatcgtccgtttttatgctcacacacccaaccgtagtcgccagcatataccgtggcgccgtcgccaacgttcgggatgttatccaggatgcgctgcaggtatgatggaattttctgttcttctactgtggtgattgggtcaacaacagcagtatctttaactttcggtgtcttggccatgttcagttctcctatagactttgatatatttaccacagcaattgcattggtattcatgcatacaacgcccgtcgtcattaaagtcacatgccccacaacgacagaataattttacgaattggctcccttcaatattcctgaccgggaaatgtttgtatgaatattctcgcatttcaccgtcaaattgaaaagaatcaattaagaatttttcagtcgttctataaggcccaaatgtctggcgagcatatttgaaataaacatctctggtttccatgaattaactccaacaaaaaggggccgaagccccttattttacgctgtcgtgattaacgataaagcccttcaacgtcaatggatttgtgttgacgattatactcagtggtgtagtcgtctagcaccagatattcacagcagcgaattttactggacttgtagtcatcagtgatcgacacgatgtccttcgggttcagcttacaacgaacaacgcgctggcccaagtggccgaagcattgcttcagatatgccagcgagcagacgtgcagcccataggagcacaggtctttgttgtcatcgttaacgaaggaacgcgccatgcgtacaatcgttcccggagtgttgtcgatcgtaccagagtgcttgtccatgtaattgccacggaccgacttgtacagaatgatgtcaccgtcttcggcaatctcaatatccgagtatgccatgaattcatagatgcggccagactgtaccagggacgaactcgggttctggaacatcttatc

SEQ ID NO: 722 - DNA, 2265 bp, Klebsiella bacteriophage F134/15
acaggggcggggttgctaagaccggagttgacggattttatttcagcagggcttgcagttcttcaacagatttacccgccagctcttcctgctgtttcttcttgatgagttccaggatggcctggttgtgctctacgtttttctgcagcagacaggctgtcatcgcgctctttcagcttggtgctgatgatgcttttgtacgatgtcaaagacgcagttgcagctgagagtcgacggatgtattgttgccgatgaaatcttcatcgtcgaccgcagcggctttcagttcgcggctcagacctttcgccatttcgttcagagcagtcaggctcagatcccacacctgctcaacggacagctggcctttgttggagttgaaacgcagtttcagacgggttgctttatcaaacatttttgtatcctcaattgaattcggttatattttaactttaaaagacgactttgactacacgattaaatgaaccgcttaccttcaccagaacataattgcgctgagtagaagagaagcccaggccgctgagttgcttatcactcggttctgctctcattttagcgcccaacatttcaaaaaccttgccatgcggtgctaattccggcttcagatattcattgtagaagccgcgagtgctggccgggttgatacaaccttccaggataaagaacagatggcggtttccggtctgttcaccgtcccagtggttcggagaattcaggaccagttgcaccttctggaaattctgggtacggataccccaaatttcagtttccacgccagttgtcggcaccagggaagactgaatttcaacaacctttttgtctttgacgcgcagttcaatgacggtcatctgctgtttattcttcagacctttttcacaggagaaacgtttcaggtcgccttcatattccacctcaacgatgaacccggtgtcgatggtttcacgctgggcatagttgtcgacgatgaaacggtacacgccatcacgcagcatgttcttgtctttgaagaagatgttctcaaccggtttacgctctttgttgatcccatccataccgttcatgtcaatatccaactcaccgccagtatggtaagaacggcggcaaccgcgagagaaataaatgtgttcgttcgtcggggtgtacatgtgcaggtccaggtcgtcattgttgaaccaggccagcgaaatgcgcaggaatgaatcaacgttaccgccagcggctttcacgcgctctttgatggaatcagcaacttcaccgttgtaggaccaggagaaattattaccccatctgaacagacccggagcgccttgagtttccggagcgaccagagacatcaggttggcagtatgtcgcccttcgaacatcacttccatggaacgcgctttcgggataacgtttttgatgaaatcatcgacgctgatctcttcaattttacccagcgtcttttcagtcactttgacttcctgcgccagttgatcaaacggatccatagctttccgcgcatcgatatcggcgaacagcacattgttgatcgtcaggtcttcatacttcgcatagcggcgacccaaagattcagtcaggccgagttcggcaaccgttttctgcgccttttcgatcatacctttggtgaccagggcagtcgggcggcggtagttggtcggggcgactttggcttcaaaggatttcaccgccttttccatttcaacgccgtcagaaagatcggtcagcagggtgccgatgacagtgttacggatgccgaacggcttatggtttttggtacaaccaaccagttcgccaggcccaaagttgtttcagatcggagcgaattttcatgtattcagttttgctctgcacaaaactttgtacagccgaacgatgctcttcgccgcgatacagagaattctgatcgatcagttccaggacgatttcagccgattccatagtcagctcacgcatgctgcgctcaaacacttcaatggattgggaaatttcgcctttggtggaggcgatatcttcgccgcgcagaacgtaatttattgttcagaacggcgtggaaatggttgtacgtgcgcactacaccgccagcgcccatttcgtggttgctttctacgctcaccttagccgaatcgttgaagtagacgccgacgatgttgtgctgcttgacatatttggccagcgctgccgccaccacgtcgtattcgttacccagattgacgctgtcccacacagtaacccagggttcagatc

SEQ ID NO: 723 - DNA, 2212 bp, Klebsiella bacteriophage F134/15
acggtggtattgatcgttggagcggcatgctggaaatttctcgggcgcttggctatgtcgatatgccgacttctggttggtatgtccggacagccaaaggtggatttgataccggaaaaagagaagaaataccagaagcgtcaaatggatgatgacttttggtatccgcttctggaaaacccggacttcgccgatgcgttaaaaagatgttcggcgtttccaacggtacggtaatgcctgctaacatgctggagcagatggaccatgttatcaacaccagtgaataacaatgagggggagtcacctcccccgttaattacgaactcatcgaccccggtgaaggccaaatatccatcatccacattttggagggccaattccgtggtgtcaaattccgtattgggaaagtatcctgggaatggtctgatgacgcaccccggcttatttttaccacggatattttgaagaaaccttggcgtcttttctttaatgatttgaaaaataacgacttgttcactgaagtgtcaggccgtatcttattagacttaatgcagaagaacgctcaggaatacaacaaaattttggtggggtagttgccaatgttactcgaatctgtcgtgctttcccaattgatttacaatgaagaataccaaagaaaaatattgccttacctgaaagccgattatttcgaaaatgaaggtgagaagattatattcggattaattgacgattattcgtcagaatataatgctcgcccttcggttgatgctctgtctattatgctggagaagactccgctcaacgagcatgtgtttgaacaatcaatcgccgctctttctaatatcaatgacaatacattcaatcaggaatggttggtaaaagaaactgagcaatgggcgcgcaataaggctgtgcacaacgcgataaaaacagctgttaacatctatggtgacaacaagcggcaggaggagatgaataatatccccaccatcctgcaagaagcgttgtctatcagttttgattcatatcttggtcatatctattgggaaatggctgcagagcaatatgaccatatgaattcagctgaggccaaaattccattcgctgttgagatattcaacaaggctacgcgcggcggtgtaggcaaaaagaccctgaacattgttacgggtgctatcaacgcaggtaagaccacaaccctgatagacctggcggcgggttattcagagcaggggttgaatgttttcgtgtttaccctggaagttgctgagaacatttggcgtcaccgtcttgacgcccgtattatgcgacgtgattttgaagtcgttgagaagatgacccgtgaagagtacatcgggacaatccaaaaattaaggacaagggacaacggctctctgaaaggcgatatcgtcatcaaggaatacccatctggggcagggcatactggattgtatcgtcgagatattctggaatatatctcatcaacaggcatctctcctgacgttatcattatcgactatctgggtgaatcggcgtcttcgcgtcttccggctcatcttatgaacaacaccaacgtgtactatacatcagttgctcgtgaattccgtgctcttgggttcgaatttgattgcccggtgtggactggtatgcagttcaatcgtgagaagcaatcagccacagacggggatatcagtgacctggcagatgctatcggtatcccgaaggtcgccgacttcatcatggcattctatgcaccggacgagttggctgcagtcaagaaggcccgcgccagtatcctacaaaaaccgttatgctaacaaacagaaattgaaatcgttcttgtttggtatggatcaggataagcagattttgtttgatcttgattggaatgaggtcaagcgagatctcaccgaagaagaagccaaatatgttgagaatgtccatatcaaacatgatatgaacaaaacagggaacgttgtgaccgacgcgaagaaagcggaaacggtcaataactggaactttggttgatttcaataaacggatcgtgaggtataatcttcatgatctgaatataaacccaggagcacatcatgttgcacaataatttcatggcggatctgctacgcgccgttgagcaggtgtgccacaccaagaaggatacgatcaatctagacttcgctcagactatcgaattctttaaagcacgccatac

SEQ ID NO: 724 - DNA, 2032 bp, Klebsiella bacteriophage F134/15
ggatacgggcgttgaggtcgctcaacagatattggcgacgatcttcataccgttccagccgatagttgaagaatgcatacagcatatctttcctaaccattaaaacgttggataataccgcattcgttccaagatgtccaggtcggcatttcagctgagtacaaccggaacatctgttcaactttggcgtcatccagtttagacaattcaccacgtttgaacacaacagtgatatcccaaccatcttctgtggaatcgttggaatactccgtgagaatccctgatttatacagcggaagaataatcttggtctcataatccttggcgaaccaacccaccgggacttcagttatgcgtagggtagtggcattgatacgttcgtacacaccgcgacagtacactcgaccttcctcagtgtatcctgtctcccccttgtaaccattccaatacggtttcaagtcatttgggtcttcgccacggagaagcgctctcagggcatccagaacagactttatgctatggcatggggttttggtagcatagccgctaccgataccgttcataccattcacgaggaacattggaataaccggcaggaaaaactttggttccagcctttcctcaccaagataattgtattccaggatgccttcatcttctttccgatagatcttacgaatcacgccggatactgccacagaaatatatcgcggtgatgacgcttctttacccatgattgatccgaactgaccatcacgatcaaaatacgggatattgttcgtccctgggaaagcctgtgccatattgacgatagtgttgctcatgttctcaccaccagatttgtaattggtacgggcggcggaaaacatacccaggcggtcaacaatctcttccttaccgtattccaacgcagcaaacaaaatttttcgctggctgggcttgaggctgtcaattaacagaggaatttggcgaacgctgttaacaaccgaaaattccttatgatcggtgttaacaaatgatgtcacagtaatgcttttggcaaccatcttattcatcctctgtttcaaataagcaaacgtcactaaaccaggtcttgcggtaatccgacgccttatcaccgaacccatcattcaatgaattcttgtaggcatcatccagaacgaccgtcgtagtatacgcatccagattgtttagaatacgtttgaaatcttcggtgctgttaccgcccagaccttttagatatttcttctttgtgatctttttagattctggggtcttcatgaactcttcgtattcaacgttgttcatgaattcatgcatggtgttaccacaccacacgcgcatgtacggggagcgcagaagtttaagacgcccctggcggacatattccggccagaacgtacagtacatggtaatcaacaggccacggatatgaatgccgtcatcgtccgcgtccgtagcgacaaccgtacaaggataacggctggtgtcaatcggttgccccggtactgcgccgccgtggatagtacacaggttcttgaattcttcgttggccatgaccttggcgcgcgaagcgttcaaacagttgatgaatttaccacgcagaggaaacagaccgattttcttcgtgtcacgggcattgaggatagggttagacgcgctatcaccctcggtcaacaccagtacgcagcctgaacgatcaccacgggccgtcgcgggataatacttttcaatttcacgataatcccgtttggtgatttcttttttggccttttcaaactcagcgtcatcctggtcattacgcaaagccgccagttccttacccaacccgatggtaacatattccagcgccttacgaatcaagcgatcagacggtttgtatgttgttccaaactgactgacaggtgtggtcatgcgctctttagtctggctatcgaaaccgggggttatcgatgtcagcagatatgaaaagcatcatatggttcttgatcatcgctggcttcaattctgtcttgtaatttttagacagcgg

SEQ ID NO: 725 - DNA, 1910 bp, Klebsiella bacteriophage F134/15
gatcccacgcttgaattcaggtaatccgggttccctacctttgcgggaatgccaatgcccgtgaacattatattcccaacgatccaggagtacgggcacatgagtgacaatcactttggagatactgccgtcactccgagccattttgtattcaaacaaagaacagaatttgctgatccattcactaaggaataactgcatcagcattgaaaagactgtcgtgattcccctcgggttactttgatgttgaagttgggacgccaatcatcaggaaccttgccatgcatctttggtaggttacgcgccgcgccttctcgcatcagttggatgaaagcatccgggccaccgaagcatgtgtcgcccgtaatgatcaaggaatcatcccggccacacgtttggaatatgctgtcgataactgcgatgtcgtgttcatcgactgtttcaaacccacgtgatttggggattctttttatgtttcagggtggggatcaacccaaaaagaaaactttacccgccatattcttttcctctgatatcattatagaaattgattaacatattgtcagtccatcctgaccagtcgaatacatcaaaatcagccacaccttggtacatattgacgatagcaggcgaaaatatgacatcaacctgatttttattcgttgtcattcacctgaactttgatccagaacaaagatcggtcttccagaatatgtgccaatttaggataacgagaggatatttccaatgcccacacatctaatatagaacgaaaatcatcttccattttataaatgaatgctgtggaaatcggatggccaagatatggactccaggatttatattgtgttacttcctggatgctggacaccaatggtatcaccaatccccgctgatattgtgctgacaaagaagggatagaattaagatatgacaatatctcttcacgctgaatctgtgttaatttcattttacacctcgatatgtcacaccttaatcattccgagagccttggagatatattgttccgccccctttaaacgaatccttaatgatcttatagaattcttccctggtcacaatatgactatcagccatatacgtgttggtcgtgacaccgtgagaatcacgggcataatgatggtataattctacaccaccaacattgaatgtgacagttctggtacgggatatgctcatgattcgtctcgggttagatagatatatcacaataatacgttatttcgtatatagaaaagccccttagtggggcttcatctttatcagatttataaactttccatcggcctattccacgccattcaccaagattgttccagacgtgagatccaacccagccaccaacttcataataatgacatatgcatgcccagaagtctttgaaagttactttccgagttggtttcacacatgcgatttgccagcgggttaagctgattgcctggaacaatggatggatataattgctatagatcaaatatatcgcgatgagcacaatgcatcccacaaatatcataccgatagcagtagaaaataaacattattccacctttaatcccatcagatcttccatggttttctggatgcggagccaatccagcgcagcatcataacgaggatcatggtataccatgccttccagttcccatgccttgatgccggcatagcgatccatctggccaacgcctttcagccagctgacgatatcaaatgtgtggtggtaatcccacggctcattggagtattgcccgcaggtcacttcaatgatatgctgggctttacgcaggtcgaatagatttcgatcacaccagtcaaccgatctgggatcaacccccaggcgatgacaccctttgcggatttcgtcggccagctgatagatggagatatcg

SEQ ID NO: 726 - DNA, 1880 bp, Klebsiella bacteriophage F134/15
acgttcaaatgttggcttgtcatctgcattcttgtcgtacactcctgagaactatcaggcggcgtacatgtatgcaaatgtcaaagtcaccccctaccgatgcgacgacagcgccaagcgaaatcatcatggatcgcaaggttatgtttgttggggccaaagatgggaagtcttacaacttcaccgttgagaagcctgtgtccacaaccctgcgaccagaaggatattatctttttgagaatgtgaaactcattcagggtgattggctttacaaaacgtatgatgttgaaggtagcgcgatcagtacatacaagatcccatctactaatgtagatatcaatcatctggttgtcaacgtgcaggaatctgagacttctgatgtgtcttacacgtttgatcgttacaacagtccgtttgatctgaatcaatacgctcgtctttatttcgtggaattgggacttgatggattctatacctttgaattcggggatggttatatttgtcgtcgtgttgaagatgggaacgtcgtgttcttacagtatctagagacttccggcgcggacggcaacgatatcacttcggtttcatctgcgactgcgattgctgggaacaacctggtggatatcgaactcgtatcagaaagaagtgcaggcggtactgacccagagtccatagaggataccaagcgtcttgcccctctgagctatcaggcggatggtgcagcagtagccgaaacagactatgcctacctgacagagaaactcttctcgaacgttctacgggctaaaggctatggtggagatacgctcaatccaccggaccctggttatgtttacatcgctgtaatcccaactgtgggagaaacactttctgacgctgagaaagccgatatcgtgtccacccttgacaaatacaatgttggttctataactccaaaagttgtggatgctgaagtcacgtatatccaggtcaacaccacgatattctgggacccgacggcaacagcgtatgctgaagacgggttgaaaactctcgtcaagaaaggtgttgtaacctggggaaccaataatcttgacaattttgatgagctgtttgacaaagaagttttacaaaacgccataacagatatggagcgttccattgtttccaatattacttctgtcgcgtacaagcgtcacttcaaaccagaatatggtgttcttgacagcttcacgtttgatttcggtcgttccatcaaatctggttctgttattatcaacgggttcaagccgcttccagctgaagttgacttcacttattacatccgagatgtaaatggtgttctcaatatgtacaaggtcagcacttctgatacaacgaaggaatatctggtgcaggctgtcggtgtcgttgattatgcgaatggcgtcgttgaacttcaacagatcacagtgtcaaactatgatgaaggaggcgcggcgattgtcgtatctccagaaggattgaatcagaacatccaggttacatccaatcaggttcttcgtattggcgatgtggccgtagacgcggaggtccgctatgtccaaagatcttaataacggacatctgggcgtcaaatatgagacgccgttgttctatcagaacgatttccctctgttcattgagttcatggatacgttcttcaattggttgtatcgccaaaatggtttcaccgaagaagaaatccttgcttacctggcagacaccagttggctgaatccggctagtgacgccagcccgctgatgcagctggtagacctgaagatacagaagacgcccggtactgctgcgcgtgatatgctccttgacaaatatttggtcaggacatttgagcaaatgatggcgcttgatactgaagaatt

SEQ ID NO: 727 - DNA, 1860 bp, Klebsiella bacteriophage F134/15
aaaatatttagtataccacacaacccatcgtatgaagaataaagcccccggaggggcttattttatttctgtcatagtggcgaatttttctatacttttcaaattatcgtatgcctgtgtaatcgggtctggaccagctggatcataattcgcagttaaaaatatagattcaaatggttctaatgattgatcgttggaagcccgaaataaaacattgtaaaccatagatttatgatctgcatttatagtcacaattcctatagagatatttgcttctactacatttatccctttgtagacagtattcatagtgtacataaattactccagaattaaagacaatgttaagctcgtggcggctaccgtagccgatgaagctgccgtcattaattgaacaactaaagtattgtcgcttgctctcagatatgctgaagaaacagcaccacctaatgatccgttagcagaaacagaagtaaccccttttatatgggataccaacctgctccccatagccaacgtcgtactagaaacagtattggctgggatagaagttgcagaccaaggtattgtaatgctaaccgagcgagcatattcaatccttactccatacaaaaagaaatcgaactgaactattgttcctagaaaattaatgctccaccgctcgccaactgagaagcgttcaaataccatgaatattctttccaaccagagttagcaggtatcgtaatataattcaaaccagtagattgccctgaaaccgaatctgtgatagcattcccattaagtaaaagttgaagctgcccatcagaggaattaacatttttacagcgaagagaaacttttaccattctaccagaagataacatatcctttggtatgaaagctctacgaaattcagaagatgccggggtattcatacaagtaccgtacatcaccgcgtcagcatcaacaacaaagttgttactatcatttgcaccagtaagttggtgaacagaaataaactcgacgtcattctttttggcggcataagaagttggtttattacctgtactggttcttattataggttcttctatatcttgagaataagaactggtgttgactgtcgacataggagcattactgcggttattgtggcccgcaagagcaccacccgccgttttccaatagttcgcattagtacaaccccatgccatattgtcagagaaagtaaccccataattggcgtttgctcccaattccaaaatcgtatcatacatattatgggcaggataaaaatatacaaacccattgtcttttatagaaaccctttcaaccaaaccagcatagataacggattttgaagaaatattcggactaatgggagtggaatcccattcaaatttattcccatgaatccaaatcaaatcagcattagacctatccgacatatggatccagtttccgctgcaggaaccgaatgtattttcacgaatatgtaaattattaacgttccaaggtaaagaatccacataatctttgatatagattacaggattaccatcagcgccaatattgttcatatagcaagcctcaatccggctttccataaaatcttccaacgtaaatgcgctaccctgagttaatctgaaacttacatttctaaattcatgactagaagcgtgaagaacacgaaccatatcagcagcacaagccgtagttttcaccaatgatgcttaatccagaaagtccgccgccgataacccgattcccattcccggcattcccattgccagaaccggtgaatgcgaaaccgtactcagcatcagcggcaacaacaaatttacctccaacttgcctataaccactgataccatttcc

SEQ ID NO: 728 - DNA, 1705 bp, Klebsiella bacteriophage F134/15
cgttacaaaatccacgtgagaaaggacgtccagcgccttccttctccctggacagaaaacgagatactacggcaggtcaagttctgtaacgtccggagagagcacgacaggcagtctcagcacctcatccggaatatcgtcgagaacaacaacctgtctctggccgacaagatgttcaactgccttctgttccgtatgttcaacatgtgggatcccatccagcatgttctggaaggcccggtctccatcaatgatttccgtaatatcaatttggatcgaactcgtgaacggtttgcggactttgacaaaaaaggacggcgtgacattcaccaatgctttcaacacgggcgggctgaaacaatgtctggccttccctgaactggccgtgactggtaagcccgccagccccacgcaaaatgatggtgaaagtttatcgccgggggataggtgttgttgacgtccttccttacaaggtcgcaaaacaaatggtggaagatcatccgggtgaatacagcatcgaagggtgggaaccgcatatggggatgcgtgttgtccggttcctgaaagcgtttgttacccataaccctcatttcttccattcgttgttggggttcaattcaccactatctgtttatgaagaattacgcgataaagtagaaggcctcggatcattcttggcatatcaggtttgggttgacttcacgtacaatccggattatccgtttagtgaaaaccatttcactatcgccgggccggggtgccgcgccgggattgatctgttgttcctggacaaagatggtatgacccacgaagagtgtatcttctggctccgtgataaccaggatcaggtctacgggcaatatggttatgttcgtgaacaattctggtcggctgaagcaccggaagatcaatgcatgaacgtcatgcagctggaaaacatgttctgcgagctgagcaaatacacccgttgtgttgaggctgtcatgcgcggtgagaagcctcgtggtaaggttggatatgacggaagcggcgattataaaaagcgttgcgacgaagttgttctcaaccgtagttctgtcaatcttctggaaaggatgaagaaatgagttggaaattattcaagttacgcaaagccacagatgaattcctactggaagctcgtatgcaaggtcgtcttgtgtacacgccttatccaggaaccacgcgcttttgcaatacgttaagaaaacagaattctgtttctggtcctagaagattgatgaatcagggaatgttggcatacaactctggggatacccggccttgtgacggcgcgaagataatctgagccaatatgatactggaataaagttttcaataactgtaatcggggtatattgacctcactttaacgaagcgcctcgaaccggggcgcacatttgaactgaaacaggaagactatatcatgtcagtattttaaaccctcgcagttgctgtaaagaatcaaatcaccgcgatgtccagcaatggcctgtacatgacttcggttgacaaagacgccctgtgggatctgtacctgtcatctttcccggaaggcacgaacaatatctaccgcgagcgcactgagcacgattgcacctgctgtaagcaattcatccgtaacatcggcggcgtcgtatcgattgacgctgatctgaacctggttactgtgtgggacagcgtcaat

SEQ ID NO: 729 - DNA, 1658 bp, Klebsiella bacteriophage F134/15
tgtgaaagtacgcactgacattatcggtagaaatcgtcatgctatccgcagagccatagatcgatttaccgttaccgtcaacagtcagaggataagtggaaaatttaccataaaggtcacacacagtgatgctatcaccaacccgtttaggggaagggaaaaccaccgtagaggcaccgtcgatgttatccaccagatatgcacgaccgagctgtaacaaggaagaggaggcatgcggaaggagttcccagcgcccaccgttaccgcccccaacgcggcaaccaaccgccttcgttgtaatagccttcaaactggtcgtcatcttcgttataacggacagcagaaggaaccccagatgcgtcaggagtttctggcacagtcattaccgcatctgggccatgttctacaacaccattattcagaataccttcttgaaatacggattgatcttgtgattcaagcccaagcggaaaatttggtttcgtgggtttattagccatttgaaaactacccctagcacatgtaatcgtctaggggtatttagtttaagatttagaaagaagcacgaagtgaataatcgacagatgctgcggttgttgtattagcattcgtcattgtcaggcgttagtttacctgaaaacaacagaacctgcgaacgacaaacgtccccgccgttacttttttgtgttaatgacgttgcctgaagagtaccgtcatacgtcattgtgaccaagaatgtatcaaccaatgtaccccatttagccgtaatcaaaatttgacacagattcaccaaagtgaaatcaggcaacgcagcactaccagaagccgggacagaaacactggtggtgttggttttagccaattttaccgaacccgccagcgccaaattcaaggcgttcatatcagtagtgtatgtcgacacatcgactttgtttgtagccagatcactgatttgaccgtctaaactagcctattttagtgtcatacgtcgatttgtcaaccttattcgtagacaggccgctgatttgactgtcaaggctggtcattttcgccgtatacgtcgtattatccactttcccagattgcaaattcgctatctgagaatccagactggtcatcttcgtcgtatatgtcgcagtatccagtttcaggtttatacggttgttgacactggtgaattgcgtttcaatgttcagcatatctgaatcataatccacgaccttcacgtagtcgttgaaacggatgtcagcgaaaaaactagttaaacagacttgtcatagaccatatttgtgacccacctgttggtgaatacacagccagcgattgagggagcgctgtgtctgtcctcacgacaagattggagagatcgacttccaatttgttataaccattggaaagcaacgaaatcttcagaccagaaccagaaccgacggagtccacagtgctcagaccatgttttttctaacatgctgaggttcaccgcatccgtgttggccgcaggttcatccgtaatcgttatggtacgttgggacgggactacgatgccaccatttgcattcagaacagacgcaaaagtctttttcccgttttatcgtttgttcttgcccatcggtacgaacaactttattggtacaaaacatcgttcatcgtatcgatag

SEQ ID NO: 730 - DNA, 1553 bp, Klebsiella bacteriophage F134/15
atacttaaaactgactgcggtcgacgatgaggccagcatcgtcgattgtatggtcgaagttgaactgaaccaagataaaccgggaattttcctgggtatcaaggaaacactgagccgaatcggggttaatactcgccaagagcctgaaaccctgtatcaaacctgccatatcctccacaaatctggcaagtattttatcgtccatttcaagcatctgtttatgctggatgggcattacaacggctttcagcgtgaagatgtcctgcgtatgaatcgcatcattcgtcttctggagcagtggaagatgattaaggttctgcatccggaacaagtaaccgaatgcgccgacatgtcccgtatcaaagttgtgaaacacgatcagatcgctgattggaaactggttcccaaatatatcattcgcccatctcgggccaaaagcgaataactggagtcgctatattatgacaactacatttagtaagaacgtgagactgaatctggcttttggtaatgctaaaggggacgtaaccgcccccgactttagcaaaattcgcaatcaggcgaaactcgttctggaagaaacccgcgaactcctggaagcggcgtatttcgatcatcaagtagttctgacattggaacttaatcctcgggaaagtgaaacgccgaccactactgaagatctgatgaaagccatcatggatgcgcagggtgatatcaccacagtcaacgacggcgtagctcatattgccggtttcgacggtgatgaatgcctgcagcgcgtctttgcttccaacatgagcaagttcatccgttctgaagatgaagtcggcccggcgctggactactactattcccgtggtttcccggaaggccagctgcgcgttgaaggcgaattcccccaggcatgcatcaaggttaatgaaaccgtgatgtgggaaaggtaaagaatatccggctggcaaattcctgaagaacatggcggtcttccaggaaccggatttcagtgacatgttgacggatagtccaaaacaacagatacaaaaccatcatttctagccaaacagcacaaaagggaaaggtttttgtagaccacaaaatgggtgttgcttattttcataccgatgacctcggccctttcctgggtgagcaaactggtggtgctatcgaaaatgttgttgatatgcaaggccagacagaaagttatgtccccgtataccaagttggtggcgaaaaataatccggcgctagaaggtatttgggcagcgaatgtccgtgtgttcgtgtactccccgtacaatccggaagtcacgcagctgacccgaatcgattaaggctctcagcgtttcaatacacaacagaggctataatggcctctgttttcgtattctaagaagaggataccatgaaagataaacagtcagacatccaatattgcggtgtccgtgaagataaaatcaaatcggctgatcctgtcctcacgtcccctttcatcgtaagctgtcgtatgaatggatgagcgaacgttacaaaatccacgtgagaaaggcgtccag

SEQ ID NO: 731 - DNA, 1553 bp, Klebsiella bacteriophage F134/15
aattctttaaagcacgccatacttggaaagaccacaatgtgaaagtaatggcgcaagaaggggaattggttgaactcgatttgccatcattccctttaccggtacggaccgaaactcaggaacaatacgaaattgaaggcgttcgcattattcctaagtttggttatcatagtatcgtttacttcttcctgagccggattggggcaaatatcatcccgaccggaatgcgtatctaatagagggcttaacatgtctgtagaacaaattggtttttatgaaatcccgaacgacccggcgctgcgcaagaaactgtttgacaccatcgaaaactgccgcgccgcccaagtccgtatcaaatcagaacagacgtacatcactgacgcactgtctgaaatcggtaaggcgacaggcatcaaagcagctgatctgcgtaaagtcgtgtcagaccgcgccgctggtacttacaccaagacaatcgaaaccagcgccaaataccaggatctctacgaatccctgttcccgaacgccgcgccggatcgtgatccgaatacttccggcgaatgacagaccccaaaggcccaacgaacgttgggtcttcttactttcaaaacctttacttcaataaacatccgcgctatatttcattttattgaattgttgtttctaaatcatgaggtgaaagatggacgccaaaacctaccagatcccgctggacaatgtcgtaattgtccaggaacgcctgcaaaaactggagcgcacggcaaatcgactggggctggtattcccgacggtgaccatcagtgaaccatacagaacccaacacaaagattctacgtctggcgaaattttctatcgttggtggcgggacatttctcttgaaggtgaaggcattgaccgcccggtttcatacggcggctggtctatcataggccagttcaatcatcaatacccaaaggtcattctcaacaaactgactgacgacatcgtcccgcatttcattcaacggttcgaggcagaaaacgtctcgtggtgtgagcattgcaataaatcagttcgccgcaataacacatatgtggttcgtaatgaaaccagcggagcgcaaatgctcgtcggtagcagctgcatgcaccattacgtgcctcaccagaagtccctggatgccgtaatgggttattacctgtccattcacgagctgtttaataaccaggacgaagatggaatctacggaagccatatcccgactaccgccgatacccggagctatctgcgtctggtgttccagatcttactgaccggagtcagcatcaagtctaatttgtattctgttgtcatgggttgctttgtagcaggtgaagctccgaaggacaaatcatctgaagcatgggagatttatcagaaggcaaaggggttctactttgatgccctaagtgagatggatcatatgatggaattcattgcatcgctgcctcagaccaatgacttcaatgttcgcctgacccgtatgtgtgaagctgggtatcatctgatcaaggattctaccactgttcgctggg

SEQ ID NO: 732 - DNA, 1469 bp, Klebsiella bacteriophage F134/15
ggttatttttcataaatggcgcgtggaatatacttgacgtcgatcccacgtaattgtatcatctccaccacgagtcatcaattaacttcctgtgtgccttggtggttcgtgtagttgaaatattttgaagtggccatgactataccctcaattttgaaggtatttagtcgatgtttaattctattgaggaattgacgaatgcaggttgaagacatcaaggaaactcgtgatggaagtcgagtaagaatcatctgtgtggatgctaaaatctcaggtggtgattatgatatcgtcggtttgataaaacaatctgacgggaatgatttcattgaatggtgggacagtaataacgtccatgatgggtatattcaggcgacttcgctccctgggcctcgagatatcaaaatctaaaacaaagacggggtttcccggctttttgttatcccataaagaagtcgatggggtactgctgaccagtgcgcagtcttcctccaggcgctcgatctcagcctcggcctcgctgaacatactatcaccatccagttcgataccgccagggagacggatgcctcgggcctttttgagcacttcagcccagcggcgttttaccaatgcggtcgcataagccttcagccacatatcattccacgcttctgtgttctcttccgctgttgggtcgatgttctggtagcacttgaacgccaggacttcatcgataacagctgagaattgagggtacagacggcgctggaatttcttgtagacgaatgccctgcggacattgaggacgctggtgatatcggaaaggcgctgctgcatagcaacataatcgataagacggatagataccaaagcagctttgggcactaacatcgcctgagccatctgccactggggggttgcccagttaccgatagattcaattggtggcccttggataacttcgacaacgtcatcgatatcttctggaaaggtgatatatcctttatcgatgtcttcctgcttcacctggtaaaggaagaatgcatcttggctaccgtcgcgatggtactcccaaaacttctgtaaagcatcatcaaccgcgtcttcaacttgtgttttgtcgaggttgatctggatgacaggcgcacccaatttgcgaaggacataattcataaatgaatctttgtcccgaatcttattgacggccattgacaccctccttgcgctgtatatctgaaacagtcaggcgcaatgttctaacgtcgtcagaaaggctgctgctgtttaatttcaattctgacacgttttgtttaacgtaggatatatcgttgttcatgacggccatcctttcactgagatcattaaccttaaccaaaatctggtcaactttcccagagttctttttccagaacattcactacggttttctaatccacccataaaccatacgaatgtcgcagaagagaccaatagagatgcaacggcag

SEQ ID NO: 733 - DNA, 1473 bp, Klebsiella bacteriophage F134/15
ccaggatgaggctgaactggctccagttgcacttgatctgcggtgaccgggccgaattcagagttccagatatcgacaaagcgtttgtcagaagtcacaacccacatgcgcttggctttattggaacggtcagcaatgaacgcctgggcattggcgttggtacggacgagaccgacctggcgccactgaccgaaatctttagacgccgggttagtgttcagctgaaattgtgggattacccggttgtcttccgggtaataacggacagcattgatcatcttggcatcgcccttataatcaatagcgatagccacggcatcgcggggaatcaaaattttcatttcatttcctttaaaaataatttatagacaacaggtataaagaacgataagaagccgaaccagtaaaccacattcatggttttcttttctgcttctgacagatcaatgaaaccataatgatacactatcatggttaataatgaggctaaacaagtgatcgccccgaccaataaaatagcatccaaccacttgctgttcatctttatttcctcaacatcatagccagcacgttagaacttttggtacagctgtttcttttctatcagccgtcttcttgacaacctggcggcgggtagccttttccggtacacgatgcgccagcgggtctgaaccaccaacttcacgggtcattggatggtcttcgcaatacttatagaattctttgaagacgaacccagcgtcacggacttcattgatgatcatgtgatgaatggcattaccaatgacccacagcggtgcgtcgaatggcaattgggcaacttcgctaccaacgccgtttctttttgtagaggacgtcctggccgctgtatgaatctacaacaacttcccagcccgccgccaccatttcagatttagacttttcgaactctttctgataagattcattccgagtccagcccgaatccccggcttctttaccagaacgcccacggatacgagcatcatactgataacgatccggatacgtgaagtacaacagcgccagttgctcaataggataattggcaaacatccattctggacgccatttatcagacagcatcagcggttcaccctcacagaccagcgtatatcccgcgctgagatgttctttgaccagttcgcgggcgatatcaccagaacctgtcgcggcatggatagcgtccatcgaggtccacgaggcaagaccggatttgtttgacgcagtatactggccgacaaacattaatttcagttcatcaaaggccagaccaaacaggcgcgttttatcgccgatggtataagtgacctcgcgcggctcaaggcgagtacgcagccattctatgaactgtacgacacgagtacccttgcccgtgccgcttgtgcctttgattacaatctagttttgactattatttgtcatcctcaatacgccagctcacgccgccaatcc

SEQ ID NO: 734 - DNA, 1420 bp, Klebsiella bacteriophage F134/15
ttaattgctcaatataattcttatgaattgggctacaacatgaataaaggcggtaacgatggaagtcatctggttggtaaagctgctgctaaattgacctccactggagaacatattggtatggtctcattaattgatccacgttgggatctctgtgagattgaaccagtacggaacaatgttgatcatggctttgatctcagtaaattgacgatcaaaagattaacagactaattagaattgtgtaactctttttggagaatgtataatggctacagtaaatgaatttcgcgcggccatgtcacggtgggggcggcgttcaacgtcagcaccgctggcgtgtgactgtaaacttcccggcattcgtagcgggttctgacaccattcgtgacgtatctctgttggctgtaacaaccaacaccccgacaggccagctgggtgagattctcgttccgtggggtggccgtgaactgccgttccctggcgaccgtcgttttgaggctctgcctgtaacgtttatcaacgttgtagacaacgccccgtacaacgcatttgaaatctggcagcagtatatcaacggcagcaacaacaaccgtgcgtctgctaacccagatgattatttccgtgacatcatcatggaactgctggatgctaacgacaacgtcaccaagacctggacgctgcagggcggctggcctcagaacctcggtcagctggaactggatatgtctgctatggactcctatactcagttcactgttgacctgcgttacttccaggccatttcggacaagtctctctaacgttacacgtggtgggggaatttatttccccaccactaattacaagaaaacgttgaggacatataatcatggcatacggcaaaggtttctttggtctgttcagcggcggcggtttagttgacgccaaagttgacacggacaaatatgtccagagtcaagaagagaagctgctttcaaaagcgactgttgtagctctggacgacgctcaggatggttcagtcatcctccagggcggggccaacacttacaattatgttggtgttgagagcgagctgcttaatgtcaaacagcttgttgaagaatatcagtccatggctcagcagcctgaaatccgcaaagcggtggacatcattattaacgacgttgtcacctgcgaagaagatgaaacgccggttactatcaatctcgataaagttgaaggcatcagtgaagatttgaaagaacaaatcacagaatgcttcaaagagattatgaatttgctggactttgacgacaccgcgtatcagaagattcgtaaatggtatgttgaaggccgtcaggcatatcatgttgtaactgacccgaccaagccgggtaacggcattcagaagctggtcatgcttgattctcgttgcatc

SEQ ID NO: 735 - DNA, 1251 bp, Klebsiella bacteriophage F134/15
gatgaaattattgattcaattattacacaaatggcattggcgcaaggatattctgatttccgccaatattcccttgaagacctaccttttctgtgataccaccacagggccagaaaagaatttagctatgatccatcatatgaaagggcgtatcaccagattgctaaaccagccacaaagatctaccgataatttaaacttcctggtgagcactttaatcagatacacagctcaattggcattgtcatacggttgcgcccctcaatatgggactgatgaaggaagaacgtattatcattgtgcagaaccgtcatcgattagaataaaagttgagcacgcatttgagcacaaagtcgaaaagtggcggggcaaatttggtctataagccaatcccatacataatcttgtgtgtttacattgacgggataggacgatgaccagtaacgttaacattgaaagaaagtacaagaagctctcccatgtagagcatatccttctccgcccagaacgtcatctgggcagtatccgttcaacatccgggacggtttgggtttatgaccccgtaaaagatcaggttgtgttcaaggacaactttacctattccccggcgctgatcaaacagttcgatgagattatcacgaactgcgttgaccatagcaaaactcctgaggggaaacgcctcaacgagatcactgttacggtgatggcgatgaacggccagatcatcgttgctgacaatggcggcatccctgtggtaaaacacggtgagaccaaagaatggctcccggagatgctcttcggctccctgtatgctggtagtaacttcaacgatgatgacgaagagtacaacaacaagaaatctggtggccagaacggcgaaggcgcttctctcgtaaacgtattctcaaaatggttccgggtatctaccaacgacggcaagaagtcttatctccagacgtttgagaacaatatgagcaaacgttcagagccgacgatcagtaacctgaacgcgccgggtacgaccatcgcctggatcccagattatgagcgtctgggcattaaaggtttggataacaataatctgctgatgatctaccgccgggcatttgaagtagcggcgtgtaatcctcgtctgaagatcgtcctcaatggcaagcccatcaggattgatcgcttcggtcattttgtggattacttctgccagggttcatctgtagacgaatcaggggattggtctgttgctatcgcgcc

SEQ ID NO: 736 - DNA, 1177 bp, Klebsiella bacteriophage F134/15
cgtttgatattgaggtctatatgcaggactaccagggcttcaacacccaaatgtgggagaagttcggcggtatccagctacaagatgaggtgacatttactatcgcccgtcgccgctttgcggaagttattggcaacgggccaggactggatcaacaacctcaggaaggggatctcatttatcttccgatggcgaataaaatattcaaggtcaacaacccgaataatgacgaagacttcatgcaattcggtaaatggtacacatattcattaccatgtaccttgttccagtatggcaacgaagacttcgatactggtgtccctgaaattgatgatattgataaacgtcttcaagatcttgaaggtgatggcatttatcaggatgccaccctacagacagacaaccagtttgctgatgagatcgaagaagatctgtctaccaataatgtcaaaatagactttggagaataaccatgagaccttttcagaattatttttaccatggttcactcctgaaatatatccatgtgttcaacgctattatgtctgacgttcaggtgaaaaccgagcgcggtattatgaaggtcccgttacacatggctattggtcgtcgtaatgacctgaaccgaaatgttccggcgaatgcattaccatttgcgacgatgtctttcggtcaatttgaaatcaataaacaggtaacgaattcgtatcacaacaaattggcgactaatactgcgacgtctaagcaacgaattccaatcatcatcgactttgaatacaatgtgcgtacaaagaagatgaatgaaatgcttcagatccttgaacagatttattctgtttacaccccttcaatagattgccagataaaggacaacgaaacactcaagcaggatcaggttgtgaagatccaattggtgagccatacgatgtcagataactgggaaggggatgctgctgaatctcctcatgtcgattgtaatttcatgtttcagctccatggtgctatctatggctgggattattgggttgatgacggttccggtactggtgatccaaacattatcaaggaaataattatcgaaatgtctactgatttgaatacaccgtggacggaattgcctctttggtttactgttgacaaagacggcgtccaccatccagaggatgattgattatgt

SEQ ID NO: 737 - DNA, 1163 bp, Klebsiella bacteriophage F134/15
tgccgtcaaatattacgaatacctccaccgcgaatgttcacgtaccataaggcagaaacacgttgggtgggtgaagtcggggaaatgattgagaagaccgtcacctacgttgaccgcaagttcctctacagcggggattggggtgattcctatctgtatatcttcaaaaccgaagatggtagtacgattacatggaagacttcctatattgatgcggacctggaaggacagatggttatccggggccgggtgaaagaactgactgagtatgaagatgtcaaacagactcagattaccagagcaaagttgaggacgttatgacattattagaaatgaatgctgcggtgttaaccaaattcattgcagatgaactcaagatcggactcgccatatttggtatcactaccattgccttggccatatgggttctgatctatctgattaagaggaaaggttgatggaatgttcatgtggagggcagggggcgagttcttacacccgttaccccaccgtgaaggaagccgaagctgctggattccgtgtagaaaaggctccctgtgtaatcgccttgaaagactgtccggtctgtaagaggcactctcaggacgtctggtatgagccaggcgctcaaccaaagacagtcaatttgctgtccatgatggggaaagtaaaatgaaaggcgttactgatgaccaattgaaggagatggggcgggctaactcaaattatcgcccgcgataaaacgaaaactatccgagcgctcgaaaatgaactcggggaacttaccaaggactctactaatttagaggtcgaattaatcaagcgcggttatgttgtcaagcgccgtttttgggaatactgatatggcaactctcgtagaaacattatttcctggctgcatcgttggccgtgggtgttctgaggccagcggcttggaagcagacgtagaaccgaagaactgtatcattattgataagttccatgacaatcattatcctctgaatcatcgccgtgatcattacctggtttcggtcaatggttgccttgcatccctgcgcatttgccaggccatggatggatccgggtatggtgcatttgcctatatccatgatgtgtctaatggcgtgttgggtcaggaaaccctgatacgaaaaattcaatgg

SEQ ID NO: 738 - DNA, 1116 bp, Klebsiella bacteriophage F134/15
gtatccggcggcgcgattgcaactgcaatagtggtaaaaatggaaggcgggatgatgaagcaagggggtacgttcagatttgcctatcgttactgctggggcttatgcccatgatatatcatttagtgatgtaacatttgttggtaattattcacatacggctgttactgctcaaaaccagaatttagcacaatggggttctttaaacaattgtaattactacaatcaatctggtgggatcgtcccgcatctgatgctctggtctggtagcataggcacttcagaaacagctatcggtgcaagtgtacacgacggtaatacgcttatcacggcgttgaatattaacagtattgtgacgtatgacatgtacagagttgttaacgttactggtcctgttggtcgttacatctacaatccttcgacagcaggttattatttgaatctgtcgagaaatgggcacagagtgactattgtttccggatatgggtcagcgtctattcgggaattacatgttaagtaaaaggtgggtattatgttaagaataaagaaaacagaaactatcaatttagttttggaaaatggttgttgtgtaggaaaaagaacagaagatttgaatttacttttgaaagtaaacgaaattcttttgcgtgattcttctgttaccgtcagtttattagctggtgtttccgaagacaacatgaatttctataaaattgttaatttgggtatatctgatgttccaattgacaaacaaactgtagaaacaatgttgttgtccacggaagaatttagttctgcggaaattatatgataaagcccccttcgggggctttcttttgaacaagctaaatagaaggatacgctgttgtaaaccaatgtgaggggaaacccatgaaaactcagtttaatcaaccccaaggctcaactgccatagaagtaaaccgtcaaactctagcgagaatttgggggtatccaatcagatctacaatttatttgaatacatataccaatgttactgggtcttctattatttttgtaaccggataccggaactatgtggtatacgggcaccgcacaaggaaccccggtatcctgggtcgtaaattctaaatcatt

SEQ ID NO: 739 - DNA, 968 bp, Klebsiella bacteriophage F134/15
cgccactgagatttcaacagtcggtggtggcgaccaattaggacagatggaccacgtcaattacttccttgaaaaactgtatagctctctgtttattccaaagagtcgtatccaggaagaagggagcatcaatattggcggttctaatttggctgagatcacccaggaagaactgcgtttcaacaaattctgcgcaggtttgcgccgtcgttattctaaattcttctctgtaatttttacgtcgtcagttaattttagaaaaagattactgatgaacaagattgggttagaaaaaattcaaccgttcgttacgtttgaattcacctcagacagttttatccgtgaacagcaagaaaatgaaatgcttgctggtcgcctcagtgccctgaccggggttgagccttatatcggaacattcttctcaattgattacgcgatgcggaacattatgcgtatgtctgatgaagaaattaaggctcagcaagagaagatcaaagaagaaaaagataaaggaatgtatccgaaggttcaggctgatgaaagcggtgggtttagtggacaagatgttagcccgctgaaatggcgacctgaagtcgtacctttccagggtacgcccggcggagtagaagagtaaaaatttatcaactaaatatagaaaattaacttcggagatacaatcatgagcgcgatcgatattgttcgagccgtactggatggtgacatcgaaaatgccacggcagaatgtggtatggaacttgatgcccgccgtgaagaactgattgctcagggtacagaatacgttctgaattccctgggtgacgacctcagcactggcgcggaataggtgattaatatggaaatcaaagaaattgccacgttcgctgatttcctggcttcccgcatggacgaacagaaagtcatcgataaagtgaacgcaaaaggtaaaacgccgtcgtcgtttaaaatgc

SEQ ID NO: 740 - DNA, 932 bp, Klebsiella bacteriophage F134/15
gtcataaaccgaatcagttcgccctgggaatgctttgtggtatatcattcatgatatgcctggaaaacgcagtcagtcttgttgcggcccctgacttccctttggtcagatttatattgtctgggctgtttggtgctgtatctgtcgttagtttcctgatcgcatccaggaaattataaatctgctacacacagcaatatattgatttgagaaccctatatcatgttcctattacacaatgttccaaaagaccgtatgacgccggatagcgaaggcaagacacattacaacatttacagtcggagccgcaccgagctggggagattcctgtctcattttgcataccatcccatggatactgtcgatggtgttttcaactcgatggaaggctactggtattggctcaaatatcggcacgatgacctgcgtagcctttatggaaatgatgccaaacaattcggtcagactctggccaagtcgcagattgttgttctgtcccctgatgatcccaaatttaaacacgacatcattgcagcaacaagccaaaaattgctgacgatgccgcccaagctgcgtttccaattagcccacagccgccttcccctcgatacatgcatatgaacatcagggaaaatatagttttctaaaactactatggactttatcatacaacacatcaaccgcttccgtctagaaggatatttgaaatgaaatttctgcgtaatattgtcaatacgtcatatgaatgtactgtggtcaatccagatcgttctcctatttttcgtcttctgtaaactggtggaagaaatatgtgaactttccgatgtttaccacggcatcgcagcttcagaaccactcaatggagaaatagctgacgtgattatctcagcagttgatcttttgtatgtctgtgaatacaaagatgcacaaat

SEQ ID NO: 741 - DNA, 812 bp, Klebsiella bacteriophage F134/15
aataggggccaaagcccctattatctagccgagaataacaactagtttcaaattagtaaaagccgagcgactatcttttaacattttgtgtacagcatcaagacgtttgggatcgtgtaaagtatcagagaatacgatgatatcagccttgtcaatcttggtgcctctataatgactagtcgtggtggtactgtctttcatatcaacatgcggtgcaggtgcgttataaggagaagaaggagagggagaagaaaagaaagaatcacgctccctttcactgtgaaagacagccataatacgaacattattttctgtttggaaattgtaagacataagtttcttcagcgctgctgtatggcctgtctgcctgatcatacggtaatatagatgttgcccggttcaataacatctaccaagcctccgcgattcgcggttctttttggatttcatacgcatccaatataagttgttgtatcatctcaacgtgagcattcaatgagatttctactctgcgttttaccatagattgcatttgtgtatcctcggttaagttccgctcatggggaactggtggattataccccgagtaacacataaagaaaaagaggccgaagcctcttttattcatcatactcgcctgtcctgaaattccatttcttggctttgttgaagtcaatatccttgaaaatattcccaaagattttcttgaattctgattcctcttcaagatccttcggtttcttcacgggttccttgaccataccgccttcgggtttccccacatcggcggtcgtggtggcaggaggagaaga

SEQ ID NO: 742 - DNA, 760 bp, Klebsiella bacteriophage F134/15
gttggcgtggtcatatggaaaatattgttgaagccatagatgctttggccaataagaaattcaaacacgtgattatcgaagctcctaccggagtcggtaaatccctcatcggcacaactatccatcaggtgttgcgccatcttgtgcttgaagcaaacccctatggccaattccgtacatccatttccacgccgaccaaaggtctgcaagatcagtatgcggctgaaaaggctgttgctatcgatatcctgaaaggcaagaagaattatcgctgccatatgcatccggatatctattacaacgcagtgcaatgccgtatcgcttgccgggatgggcattgtagtaagaggcgttgcccctatgtccaggcacgtaatctctggaccaacatctcttcattacgctgcacaaacgcagccatgatgatagaaatgtgcaccaccatttgtatgaagccagaaaaccgggccgacatgcttattttggatgagtgccataaaatgccctctacactcctagaccatacgatcatggaatacaatacgaaggtattggaaggactgagatcgttgcctcaggggaaggatatcgtccaggcagtggttgagattgtatcccattgcaaagactatgaattgggcaagctgtattcccttgatggttatctgttcgaccgttttgtggacttgttaggaaaggtggaagcctattttaacagaactgcatgaactcgttgaagatgaccgcctgaccgaagccc

SEQ ID NO: 743 - DNA, 702 bp, Klebsiella bacteriophage F134/15
gttcatcgtatcgatagcagatttcaaggacgaacggtaaggtgtgctgacgctggagacagatcgtcatctactgtgatgtcattgacgacatcagttttgttcagttttccatcgaccgcatctagaatactatctatctgctggcctgtatatttgctcagataatcagccattttcttaactcctagtgctttcgaggaatactttgaaaccagatggatggaagtgttgacggaacacgcgatcgaatacaccttcgaaatctgcgacgtcgccaggtattcttatgacatatgtgtattcgtcatagtagtaatcatcacgaagaccaacttcaccatcacaatcaaagttagcatccaaaccagccaaatcttcttttgggtaatacacagtaacaggaacaccgaaataaatccagaagaacaattctattgctttctgcgttccccgtattttatagatatgcttcaacagttttaaccagcgggtgtgatctaatgtccggcggcgcgttccctcgatataaaccgagaactgattgccatccgctgtaataagaccttcagagccttctggtacaaagaacccaaattcaggaaaagatttgtcaaccgttctttgaaacccgaattctttataccaggcgtcaatacttgaattcttgtcttcaggtgaaaatagaggacgcccatcaga

SEQ ID NO: 744 - DNA, 504 bp, Klebsiella bacteriophage F134/15
cagaagctggtcatgcttgattctcgttgcatccgtccagtatacgtcgttgagaaaacgatgcgagaaggcggcatcgaggcgatcgaaaaggttactctcaagtattactacaatccgaactacaaccgcaaccaattcactggtcaatctgggacatctcagaacttccagccgtctcaacaggaactggtatttgacgaagaaagtatcgtctatgttgatagcggtgaagatcctttggcaaatggtgttgttcccggtctgctgaaccctgctatccgtccgctcaacaacctggttacggttgaggatgcgacggtaatttacgccatcacccgtgctccagaaaaacgtgcattctatctggacgtcggtactctcggtaagaaatctgccgaagaatatatgactatgatgatgggtaaattcaaaaaccgtactggcatttgaccgcagtactggtaagagttacgggcaacagccatctgagtggggattgct

SEQ ID NO: 745 - DNA, 324 bp, Klebsiella bacteriophage F134/15
aagtcatgttgcttctcctatcattatttgaccgcacttatggcgggccgggttttaatagttgagttgtgatcaaccaagggctgctagaccttttatcccgtttgcgcatgatcagttcatgcgagtcttatcaagcaccttacggcaactcttctggatgtcatcgccctgctgccaggctcatcccaggagtttatttttcctagggctttccacttacaagtcttaaccagaccgggatacgggcttgtaagatcgggttggacacaactttgaggacactgacgacgtctactagtcacccataactgatattcggat

SEQ ID NO: 746 - DNA, 316 bp, Klebsiella bacteriophage F134/15
tcagcttcacccaggttctcttcagcggtcttgcgcattttgattgcctggcgcacattcgagacacgggcttcttccaggcggcggatttcgtctgacagtttacgagcggccaggttcaggcgcttttctgtatcggtcagcttgtcaagccctgcagtgacgttggcttcaacagtggtgaagatgcgtttcagttaagtttttcagtgacatttgttcagcctcatttggttatatgttatcccatattatatctgggtatttttatagattattctttcggtggttcacaagaagtgaacgatttctttcc

SEQ ID NO: 747 - DNA, 194 bp, Klebsiella bacteriophage F134/15
ggcctgcaattgctttatctagagacatcacatctgaaactcaatcgatccggtcatttacagaacgagcagatgatactcccttctattttagattgggattccgatagctctaatgatgatagctctagaatattcgtgctatcgcagacggcatccgtaccctttatgtgccgtctaccagaacatttaat

SEQ ID NO: 748 - DNA, 6556 bp, Klebsiella bacteriophage F141/15
cgggtgcacgtctatacctggacctgaaatttattagactcacgcgagccctccctcaccctgaacgcgcccaattcgcccccagtaggggggtgcctagcgtcaagggtttagggggggggggcactagtggggcctgctagtgcgcaccagtgggcctcagcgggcctgtgctgcgttctggggcgtatcgctagtgctaccctagggctatccctgtgcgctcactagggcgcttcctgtgcgctccctgtgggccacaggggtgcgctctgccttgctttattttgtgcgcccattgcgcgtacatagtgcgtcacagtgaggcgcctagtgggccagctagtgcgctcgcagtggggccatagtgcagcacagggctattactagtgcgtactaggctatccactggctatcaatagtgctttacattgtgtcgattatatgctacgctgcgcgctccccactagggcgcacatccactatccagcgctatctctttgctcttactttcattcgaaagctagtaggaaatgaagtaaccggagtaggagggttttagggcactatacatactactactcactatgcactcactaggtactcactagtatgtccctgtgcctacgcagtaggctgacatacctacatagtcaccgcatcactacgttccttcacttacgttacgtcactacgttctgctttatgtggtattagatagtattggctagtattggctagacgtggctacagctggtgctggcacagtgctatccctaaagctatccctagcatggccctaagtatttgccctgcttaccctttttgctcttagtgaataaaaagtttaaaaaaagtacttgcttcttttggttcaatgaggctatagttcaatcaccgggaggcgctggggcgctaaccggggcagagtcgggagattcagccggattaaagctagatagtgtgaagggttagatactcgataaaaagagttgacaccgcgaaggacataagctagattgaatccagaagtgagtagtaaggggagaaagtgttagcttctcaaaggtagaaggtttactgattgagtgttgtaacggcccctaagaaataaacgattgacaagttcggatttaccgagtaacttagatagcgaacaacgtagtaagctggtttgcggggaggcccagtaccttggctggtacgatgacgaccaatcctatacaaccagttaaaaagagtaagcgtgccggacgttatcaccggggttctgaggcaaaccatactgccgaggcgagagcagctcgctcctctgaatcgagggaacaaggcgcggagtgtatcccgcaaagagtatataacatagcgtagcagtaacaaggctgcgctagatcatgttctctgagaggtaaggtatgcgcaaagcaaagcgtttagcattaaagcgtaattgggagttatcaaccaacccaactgacgataaggggctgctagttaaaccgagcaagcaagggctgtgcattgagcacagggtaagagggaagcaaaaacataagggtagtagtaagctacctgctgggtggcctactgttaactcacagttcggacgttaattacagcctatagcatcctgtggggtgctatgtgaagtaattaaacaaccaatctaagaggtgcatcatgactcattcaactggtaaagtattcaagttaaccgccgccggtagcattcgtaaagcgctgggcgatgtagtggaagcaaagcgtaacatcactatcagtgcactatttcatggtctggtgagcagcaacgtttcctgggctacggatatgcagcgcagtgatgccgctgacttcgatatggtgctgcgtacactgctgcctatcaagttcaacaaagagtccggcaagtacgaattcaacgcgaagaagtgctatgcgtcagctgagaagttgggcattgagctggacactatgcgtctggactataaacaaactgacaagcagggccgcgaagtgattgtagccagcttttatagctcttgtatggccctgtacgctgctgaggcggagcaggtgaagaatgacgcgttggatgccgatgcagtgcgcctgcaagcgctggggcgcgttaaaaacgaccatcaagaaagctaaagagactggtgtaagcgacgctgaccttgtgtctatgctggtatcgcagggagtggatgtacgcgctgtactagatgcaactttgaaggcagcggcctagtagcaagcctatagcgtcctatggggcgctatgtgaatgcaactggcgtatgaggtggcatatgaaagcaatactggtttatccgggtcatgaactcaggcccgtgtggtgcaatcgggtatacgcagaatacaactacactgtggttatattctctgacaaggacactaatcaggaatcccctttagaatttgtggatacctacaccgaaatggctgcccgcactgtgctggacgccgtgaatcttggcattatcaacgactggagacaactctatggttaatgtattcaacatcattgtgaccagcgctatgctggtgctgggcaacgacgtaaacaacccggtgccccactgcacagtgcagttgcagcaaccggcggcgcaggaaccgcagccgcgccctgagtatgacctatttgaggaccccgagggtggttgcaaagagctgggtgcgcgtatccttgcggcggtgcaggagcagtacccgaacgccgctgtgacactcattgtggacggcgaaagcaacaacgatatctgagaggtgttggcggttatgaaagtcttaaagttcattcgtaaatctgaggcgttgcgtattgcggatgcaaatcccggagctatcaagtacccgtattgtactaggaaaatacaagtccttgcctgcaagatacttgggcgaagaggccaaggtttccgatgacgtagtagctgtgtatgcagagcgccgctatgatagttttgggccttacaccaagctcatgtgtgtgtgccttgttagtggaggcggggcgtgatggcctatggaaagaatcctgagacgctgctgatgcgtaggcagcaaccaacaatcgacgggctggcgcgggagtacaacgcgaaggcagcactgcgccagcactatgagcagcaagcaaagcgcctgggtatgaccctgcgcggctactgcgtccggtttaatgtaaggggtgtagtatgattaagtatgatgtatacaggcgcccaagtgggttgctgtaccgggtgccgctttactctgggctgcattggcgggccgagcactacaacaggtatttgaagcggtggatgttatccgcccatacagtcggcgggataattacaagcaacgcgagcactctagtggcccgcaatgtggtattcaaggacagagcatgctaacagtagacgaaacagcactgctgtgctggcatctgctggaaacacagggcaagtgcggctgcacttgggaaacattcaaagaggttcctaatgaactcaagcaaatcataccggtcgagcgtagactcctccgagttcgtaagcaggactctgcggtggtgctcaccacgtaccgggagtatacagaatatgccgcgcagaaactgcaagagcacattgagtttgatgtggtcgcagcactactacggtacggatatcgtggagcctatacaagatttagggcagctgtgcgctcgtattataagcaaagacagctcgctgcgtggtatgcacgctgagctactaatgcacgacacaatacaactaacccaggagcaaatgaaaatagcaagagactaacacagcacctatcgaatggaaagtagtattaccggaaggtgcaaacgcactgccaattaaatgttctatgtattccagcggtgattactggaccccgttccaggacttgcaaatgcaaggtgctgaccaccctcacaatgagggcccactgcaggcgcttatgggtctacggggtgtaggcgcgtacactccgggcttagaggtgactataggcgggatactgcacccagagtaccgcgaagtaatgatgactcgcggcccgttgcaaaaggtggacttgtaccggtccggaactttctacgaactctttgccccggcgcgaatcaccatcgacagcaagttctgtgaacgccgccgcgacttctatgagggcgatgatgtagtggttgagcgcgtagttgctagtgtagaagagttcaccggttacaaggtgcacaagcaggccgtgcagttatttgaacgcatcatgcttgcgccagaagagcagcagcgccgcttatacactggctacgattacggacgccacatccgcgatggcaacgccgctgcgctgctcatgaagttgcacggtttcgtagtgtctagattcgctgtgccgttgggctttggtttccgcaacggagagcccatcgtgatgctggggcagccgcggatgcacaaggacttcgccgcagttactgagtaccgctgcgtagagatgcgcgtaggtaagtggctcgctaactactacggaaatggtgtggacttccgcgatgctatcgaagacctcaaggctatgaacgtagaccctacaacgtacctgtgcaagaccgagcaggagtggtacgacgcctatgagaatggcccgggtagctgcatgagcgggtactcatttgagcgtagccctgtgcgggcgtacgctaccaccagtcacgggctgccggataatgggctgcgcctgttcatccagtacaccggggaactgttcggggatgactttgaagtgcaggcacgggcaatcgttaacacagaaactaacgagtatgttcgtgcttacggcaacgctgcggatgcaatcctgcgagggcacgggtacaccagaaacacggagtgtctagaaggggtaatgctggcacgcataccgcacctaagctacagcggcgcggtactgatgccgtacctcgatagcagccagtgcggtgttgatgaagaaggcagtgacgcctttgtaatccgtgatgactacgagtacgaggcgcaagaatcagaagggtacatctacgtaggcactgaatctgctcggtgctgctgctgcgaaggacgctactccgtcgacgacatgcaggaaactgccgatggtgatatggtctgcgacggctgcgtcgaagaggaggagtttgtatacgtagttggccgagaagggctgcatagtcgctggagctgcacttggtcggattaccactacgcctatgtatatgacgcggacattgagcactgttcggtaggagggggtagtgcatgaccaagaagagctggtgtttgcacaggaccggcaggtgcttattgagcacgcagaagagcacccagtgcacgggttaattctcactgagcatgcggctgattgcctgggcgagaagtacctaggcaacgacgatgaagaagaagaagtagaggaggcagcttaatgttcttgaatccgcacgggattgatatgcagctgctattgcagatactgcaaacgcaccggcctagctgggcaagcactaagtggtttgagccgctgcttatgcaggcgctgggtagtggtatgcactacgtaaaggacgagcacggaaactacttcgtgctgttggggactcagagcaaagtgacgtagcgtttacgtctcatctcgacacagtggcgcgcccaacccagcgccgcgccggacgtcggctgcactaacaagggtgtgctgttcgtaaagaacccgcaacaagctgactgcttgggggcgggactgtggtgctggtatctacctgatgctggagatgctgcggcggggtgtgcacggacgctactgcttcttcgtggatgaagaggtaggctgcgagggtagcgctgcatcggtcaaggatgactctggattttggactggggtcaaggcgatgattagcttcgaccgccgcggcgacggtatcattacgcatcaaaggtatatgcgctgctgctctgacacctttgccaagaccctagcagagcgcctgggacgcacggagcagcacttacagaagggggtgtacactgactcagccgagttcgttggcatcattcctgagtgcaccaacgttggtgtagggtacatgcacgagcacaccccggactgaggtactggacctgaacatcctggggcaagtgcttgagcgggtactgcaagatggcacgttctcgcaccttccgattgagcgggacccgaaggtggtggagccggaccaatggctctctgcatctacgcttagtttacggcagccgtgggacatgccgccggacgaggacccgcaattgctggctgcgttccgcatagtgtcccagctttctaaacaacaacttgttagctgggtgcaggagaacccagagaaggcggcggagtacatcatggtgttctccgattacggctttaaagaagagctgattgaactaggcacccgagtcgtagaagactggggcgggatacgataatattgtggagggttgattatgtctat

SEQ ID NO: 749 - DNA, 5280 bp, Klebsiella bacteriophage F141/15
gatatcacgcgatgctgcgtacccggtgcaaagtaggcacgatgtcgtgggtcgataggctccggcccaagttccagcatctccactatactgccaggtttgatagtcattctactttctccttactgtacatgctagtacccatctcagcctctgctgggaatggaacctcaccaatgatgccgtagttaggccagagctggtgaatacgcttaggtgcatcctccatgcactgcttaaccagcaggctcgcctcacgtccaaccgtccgggttggcgctgtccaggtacagcgcatcgtgcacgttcgtaatcaggcacacctgattatcgaaccagtcacgggccaggagcgcacgtagaaccataccggctgctacagccatcaggaagaatgcttcaccctgacaccagtagttagccatctcggtttccttgtagtccatgaccttctgcttacgctgtccgggaacaacttccttccactgctctttctgacggaagctgtagcgggcaccagcagggctggtccacgtcccaatgcggtagattcggtagctaccgtcgtcagcttgctcccggtacatgcgaccctccgcaccggtacgctctacctcttccttgacaacagcgcggaagccgatagttgttgggaacatgcgctcttcgttatccaggaactcttgcgcaaactccactgtacaaccagcggcgaatgccacaccccttgcggaagccccatactgcgcagcaaagctaggggtcttgatatgtgaacgctttgtcttccacgtactatagtcttggtaagtcttatcgtgacagcggtagtacacctcgtcgtaatccaatccttcacggaaagctaggcggtaacagtgcatatccgtaccactctgcagcagtcccagcagtttcttgtcacccgtgtgtacacaggacataaccacttctagtgctgagtagtcaacctcagtgatacgtccgttgtccccgaatctactggtgaacacctgcttcaccttggatttagccaccccatcaccgtcctcatccgggcggggcaggttctgcaggttcgggttagagctactcaggcgcccggttacagtggcacaagtattcagccggtggtgtatgataccggaaccatccgggcgctcagggattacgtactgcagcatccccttccgctcttttacttctccgtttgcatccagaacttcccgcaaatagtaagtaccagtgtccttctcaagcgccgctagctcgttcaccaacttacagaactcgaaaccttgccgagccagtgcctccattgcgtcagtgctggtgctgtatactggcgtaccgtcctgcagggtgcgtgcctgccggaactctcctcgctctgcgtacttctcccggataacttccggcagctcctggatgctcactaggcccgggcagaagtaaaggtcgtcctcccacttgagcttctcctcctcggtatcaaggcggaatactttgggcagtcccttgttcttgccggacttatacagcgtccttgggtatgtccactctggttgccagtcggacacatcaatgtactgcaacgttccgttgacgtctgctaagtatgcgtcgtacttgacgtactgcggtgggtcatagggcaccttcttgcggtacttgataggcccaccgtatactagtgcagacatatggaagtccgagccgaagttaaaatccagcgtctccggtaggtccttcgggatgtactgctgcagctcctgcttaatctcacggatgcgctgctcctgctcctcctggttcttgcgtgcaattggcatattaacgaacaggccgaaccattcgcagtacgcccaagccagcaaggcatccatacgctcccacacgtactgcatctgattgcgctgggcgaacgtagcgcactggccgtagaagcacagggccgtgttcgggatgtccccgttaactaggtagtcatgcagcagcatcgggtcaatctgggaggttagcacaccctgctcccagagaatcttaaccccgtctactttgtgcgtaccaccgtacttaggagccgtctcgtccagcgacggatacatgctctgaaagtccgaggcgatgtattccccgtgcattgtgcagaacaccctgccgccgcgcttgaggaaggcctcaaactgctgccgctggtacgtgagaaaccaagaaatctcataggctgcgttgtgcgcaacaataagccagcaatcctcggggatatgaaaccaccggcagccttctgctgcactgtttcccgccaagaaatcagctcttgaattgaagcgcaccgattgagtcgcgccaacagtggtagtaccgtcagcctgtgtcgtgtcgatacgccatgctgactcaacaacatagttgtcagggcagtatgggcttgctttagagccgtaatattcatggttctccgtctccaggtcaatgtgcattatactggttgtcatttccacttaaccctccgagctttattgatagctagatgcacaatcagctggctgctgtccagcgcgaatcgtttacggaaagtacctgcagacgcagcgtacgccttgattacctcttcatcgaggtagttaatgtctgacggtttaagcatagtagcctcctagtgtacctacatagcgccctcatagaaggcgctagggaagtcaccggttaatctggccttcgtcaaagcggcaacgacccggctcgaatcccacctcgaattgcaggagcgactctttaccagatagtgccatcttgttcttcggagtactgataccgcggacgttttgcatgtgcggctgctcattcctgtccaagcaccccatcataatcgccaagtccaaggcaccttgtacgccaatcttgctctgcttcatagcggtgagcggcgggaacagcatgttgtaaccttcgagtgaaagctgcatagtgcctacaatagcgcagtcgttctcgcacccaaggatacgcagctcctgccaacgtgcttctaggttctggtgctcggtctccatagtaccgccacggatgttagccaccatgtcgatgatgattaccgcggggcgcatctcctccatgagcgtggatatctgggccatcgtcaaggagtgcgcagccttaacacgaatccggtcagccctgcctactttcttgaggtaggctggcacgaactcttgcttactgtgccggtccttaatctcagccagagtccagtgcagcgccgcttgatataccctcggcactgtgcgcgtcgccggaccctcgttaaccagccagagaatcgggcggtccccgtatacttccggctgctgctgcatctgctcagcaaagtccacagcaatagcagcaagcaggctagttttaccagagtccacaggagcagccactgcgatacagtccccgccacgtagacctcggatgttgctagcgagttgctcgaacacgcccagtttaagaccgccgctctcgtcagtcgcggcaagtatttcgtcaacactaccgctctcccattcaagcagcgactcatgcaccgcagcgccgtcgccgtacttgcgctgcaggtgcttcatctccagcaggtaatcaacctcctcgccgtcttggtagcgctgcgtcagcgccgccacctccccactataggccagctcgttcagggtctggacaatgcccaccacagaatcctgcggcacggcttgtacctccccgcataagctcgtccataatcacccgctcttcacgggataggtgcccggcccggaggttgagcatgctctgcattgcatcccactgaacctcctggtgctccgggtacgtgttccagtacacgccccacccagtctagtaggttcgaggtgtccggcgcaagcatcgacttaggaatctgctctcgcagtcggttccaaaccttctgcgtgcacattgccttaacaactattaggtccaattagagcctccagaatctctttgatttctgcatccttcgggtccgcagcgaagtaatgctcacgacactgcatgaacgggcgcaatgctcgacgtgctgctgctaccccagcgtgccctgccgggtcattgtccagcatcagaattacttccgggcgattctgaatcagccaggcccttagctgcgtgggcaagcgtgtacccagcatagctatagcctgcacgttcaacgcactgtagctcgtaactgcgtgctgtatcttccgggctgagagtaagtcctcggtgagcacgacctttagaggtgcggccgcagctacagccggtgctacggcaggtgccgcggcagcgaaagctattggttggccgtacattacccacttcggttgctgtcgggcatgcactgcacggcccagagcagcgcttccgacacggaagattatccgctgtttctctttgctccattctgcatcctccaccatttcaggcatgattccctttgtggtcaggaatccgtaaataaaactctgcgtttccgcaggcgcttggctaatgcaaattgcatctgcaggtgcagagggctgcaccctcggctcttcctgtaactgtatgcgctggtactgcttgcgctccttgcccacctgtttacagcggtggcaatagtattcccaggcatccgggttattgtagagcaccccggcggcgtccctgccgcagcaccgaaagcgcgccctctcgccccacggccaggcgcttgcacgctctaagccagggctggtccatagtcgatccttagctgaagattgctgcacaaagcataccccacaggaagtgcagagggagcatagctgcttgggtctcggcgcttcgccccctaaagcgacggccgcggcggtaatgcctatactacctaacacggcaaagagtagtgacctaagcattcagcttctccttacgtttgatttccatagccattcgacgaatgtcatgtgccaactgcagggctgaatcggggcgtcatattaataccaatctctcgctctgcccgggtgctgccttttctaggcactattccgatgtatagtagtccttcggtagtctcgctgtccttttctaataccagacgctggtcgtttccggggtcgtcgtttagtgtttagataggatacactagacgggactggcggcagctcctcgtcctcgggctcttggtacagctcgaagttattggcgtaccacgggtgcttgtcactgcgtgtaataagcccatctacctgtataaagcggccactagcg

What is claimed is:

1. A pharmaceutical composition comprising three bacteriophages each comprising the nucleic acid having the nucleotide sequence which has at least 97% sequence identity to SEQ ID NO:1, at least 97% sequence identity to SEQ ID NO:3, and at least 97% sequence identity to SEQ ID NO:5 and having antibacterial activity against $Pseudomonas$ $aeruginosa$.

2. The pharmaceutical composition of claim 1, further comprising one or more additional bacteriophage having antibacterial activity against $Pseudomonas$ $aeruginosa$.

3. The pharmaceutical composition of claim 1, wherein said composition is formulated for administration as an aerosol.

4. The composition of claim 1, wherein the composition is an emulsion.

5. The composition of claim 1, wherein the composition is a lotion, cream, or ointment.

6. The composition of claim 1, wherein the composition is a dry powder.

7. The pharmaceutical composition of claim 1, wherein the composition has no more than eight different purified bacteriophages.

8. A method of treating a bacterial infection in a subject in need thereof comprising administering to said subject a therapeutically effective amount of a pharmaceutical composition according to claim 1 in combination with an antibiotic.

9. A pharmaceutical composition comprising a bacteriophage mixture comprising nucleic acids having nucleotide sequences SEQ ID NO:1, SEQ ID NO:3, and SEQ ID NO:5.

10. The composition of claim 9, wherein the composition is an emulsion.

11. The composition of claim 9, wherein the composition is a lotion, cream, or ointment.

12. A nebulizer comprising the pharmaceutical composition of claim 2.

13. The nebulizer of claim 12, wherein the composition is a dry powder.

14. A nebulizer comprising the pharmaceutical composition of claim 9.

15. An inhaler comprising the pharmaceutical composition of claim 1.

16. The inhaler of claim 15, comprising a pressurized container, wherein the pharmaceutical composition is located within the container.

17. The inhaler of claim 15, wherein the composition is a dry powder.

18. An inhaler comprising the pharmaceutical composition of claim 9.

19. The inhaler of claim 18, comprising a pressurized container, wherein the pharmaceutical composition is located within the container.

20. The inhaler of claim 18, wherein the composition is a dry powder.

21. A pharmaceutical composition comprising at least three bacteriophages, wherein all of the bacteriophages in the composition are obtained from culturing a plurality of cultures of *Pseudomonas aeruginosa* infected with a bacteriophage and isolating from each of the plurality of cultures the bacteriophage therein to include in the pharmaceutical composition, wherein the plurality of cultures consist of three to eight cultures, and wherein the plurality of cultures comprises a first culture of *P. aeruginosa* infected with a first bacteriophage with a nucleic acid having the nucleotide sequence which has at least 97% sequence identity to SEQ ID NO:1, a second culture of *P. aeruginosa* infected with a second bacteriophage with a nucleic acid having the nucleotide sequence which has at least 97% sequence identity to SEQ ID NO:3, and a third culture of *P. aeruginosa* infected with a third bacteriophage with a nucleic acid having the nucleotide sequence which has at least 97% sequence identity to SEQ ID NO:5.

* * * * *